United States Patent
Choi et al.

(12) 
(10) Patent No.: US 6,448,043 B1
(45) Date of Patent: *Sep. 10, 2002

(54) ENTEROCOCCUS FAECALIS EF040 AND USES THEREFOR

(75) Inventors: Gil H. Choi, Rockville; Camella Bailey, Takoma Park; Alex Hromockyj, Potomac, all of MD (US); Charles A. Kunsch, Norcross, GA (US)

(73) Assignee: Human Genome Sciences, Inc., Rockville, MD (US)

( * ) Notice: This patent issued on a continued prosecution application filed under 37 CFR 1.53(d), and is subject to the twenty year patent term provisions of 35 U.S.C. 154(a)(2).

Subject to any disclaimer, the term of this patent is extended or adjusted under 35 U.S.C. 154(b) by 0 days.

(21) Appl. No.: 09/071,035

(22) Filed: May 4, 1998

Related U.S. Application Data

(60) Provisional application No. 60/066,099, filed on Nov. 14, 1997, provisional application No. 60/066,009, filed on Nov. 14, 1997, provisional application No. 60/046,655, filed on May 16, 1997, and provisional application No. 60/044,031, filed on May 6, 1997.

(51) Int. Cl.[7] .................. C07H 21/04; C12N 15/09; C12N 15/00; C12P 21/04

(52) U.S. Cl. ................ 435/69.3; 435/69.1; 435/70.1; 435/71.1; 435/71.2; 435/320.1; 435/325; 435/252.3; 435/254.11; 536/23.7

(58) Field of Search .................... 435/6, 69.1, 69.3, 435/70.1, 71.1, 71.2, 320.1, 252.3, 254.11, 325, 440, 471, 490; 536/23.7

(56) References Cited

FOREIGN PATENT DOCUMENTS

| EP | 0652291 | 5/1995 |
|---|---|---|
| EP | 0756006 | 1/1997 |
| WO | 96/33276 | 10/1996 |

OTHER PUBLICATIONS

Crytial Synergy: The Biotechnology Industry and Intellectual Property Protection, Presentation of the Intellectual Property Committee of the Biotechnology Industry Organization at the Oct. 17, 1994 Hearing pp. 75 & 100–107.*
Jazin Et Al. Regulatory Pepticles, 47(1993) 247–258.*
Herzog Et Al. DNA & Cell Biology 12(6):465–471, 1993.*
American Type Culture Collection, Catalogue of Bacteria & Bacteriophages 17th Edition, 1989 pp 78–79.*
Rudinger, J. In "Peptide Hormones" ed. J.A. Parsons, University Park Press. Jun. 1976 pp. 1–7.*
Davis et al, "Microbiology" p. 267.*
Lewin, B., "Genes IV", Oxford University Press, 1990, p. 810.*
Gordillo et al, J. Clin Microbiol. 31(6):1570–1574, 1993.*
Xu Et Al Genbank Entry, Accession No. B07852 (1998).
Altschul et al., J. Mol. Biol., 215:403–410 (1990).
Pearson et al., Proc. Natl. Acad. Sci. USA, 85:2444–2448 (1988).
Evers et al., J. of Bacteriol., 178(5):1302–1309 (1996).
Clark et al., Serodiagnosis and Immunotherapy in Infectious Disease, 5(2):85–92 (1993).
Lowe et al., Infection and Immunity, 63(2):703–706 (1995).
Burnie et al., J. of Immunological Methods, 123:217–225 (1989).
Xu et al., Infection and Immunity, 65(10):4207–4215 (1997).
Baldi, et al., "Humoral Immune Response against Lipopolysaccharide and Cytoplasmic Proteins of *Brucella abortus* in Cattle Vaccinated with *B. abortus* S19 or Experimentally Infected with *Yersinia enterocolitica* Serotype 0:9," CDLI, 3(4):472–476 (1996).

* cited by examiner

*Primary Examiner*—Patricia A. Duffy
(74) *Attorney, Agent, or Firm*—Human Genome Sciences, Inc.

(57) ABSTRACT

The present invention relates to a novel gene from *E. faecalis*, EF040, and the encoded polypeptides. Also provided are vectors, host cells, antibodies and methods for producing the same. The invention further relates to screening methods for identifying agonists and antagonists of *E. faecalis* EF040 polypeptide activity. The invention additionally relates to diagnostic methods for detecting Enterococcus EF040 nucleic acids, encoded polypeptides and anti-EF040 antibodies in a biological sample. The present invention further relates to novel vaccines for the prevention or attenuation of infection by Enterococcus.

38 Claims, No Drawings

ENTEROCOCCUS FAECALIS EF040 AND USES THEREFOR

This application claims benefit of 35 U.S.C. section 119(e) based on copending U.S. Provisional Application Serial No. 60/046,655, filed May 16, 1997; 60/044,031, filed May 6, 1997, and No. 60/066,099, filed Nov. 14, 1997. Provisional Application Serial No. 60/066,009; filed Nov. 14, 1997 is herein incorporated by reference in its entirety.

FIELD OF THE INVENTION

The present invention relates to novel *Enterococcus faecalis* genes (*E. faecalis*) nucleic acids and polypeptides. Also provided are vectors, host cells and recombinant methods for producing the same. Further provided are diagnostic methods for detecting *Enterococcus faecalis* using probes, primers, and antibodies to the *E. faecalis* nucleic acids and polypeptides of the present invention. The invention further relates to screening methods for identifying agonists and antagonists of *E. faecalis* polypeptide activity and to vaccines using *E. faecalis* nucleic acids and polypeptides.

BACKGROUND OF THE INVENTION

Enterococci have been recognized as being pathogenic for humans since the turn of the century when they were first described by Thiercelin in 1988 as microscopic organisms. The genus Enterococcus includes the species *Enterococcus faecalis* or *E. faecalis* which is the most common pathogen in the group, accounting for 80–90 percent of all enterococcal infections. See Lewis et al. (1990) Eur J. Clin Microbiol Infect Dis.9:111–117.

The incidence of enterococcal infections has increased in recent years and enterococci are now the second most frequently reported nosocomial pathogens. Enterococcal infection is of particular concern because of its resistance to antibiotics. Recent attention has focused on enterococci not only because of their increasing role in nosocomial infections, but also because of their remarkable and increasing resistance to antimicrobial agents. These factors are mutually reinforcing since resistance allows enterococci to survive in an environment in which antimicrobial agents are heavily used; the hospital setting provides the antibiotics which eliminate or suppress susceptible bacteria, thereby providing a selective advantage for resistant organisms, and the hospital also provides the potential for dissemination of resistant enterococci via the usual routes of hand and environmental contamination.

Antimicrobial resistance can be divided into two general types, inherent or intrinsic property and that which is acquired. The genes for intrinsic resistance, like other species characteristics, appear to reside on the chromosome. Acquired resistance results from either a mutation in the existing DNA or acquisition of new DNA. The various inherent traits expressed by enterococci include resistance to semisynthetic penicillinase-resistant penicillins, cephalosporins, low levels of aminoglycosides, and low levels of clindamycin. Examples of acquired resistance include resistance to chloramphenicol, erythromycin, high levels of clindamycin, tetracycline, high levels of aminoglycosides, penicillin by means of penicillinase, fluoroquinolones, and vancomycin. Resistance to high levels of penicillin without penicillinase and resistance to fluoroquinolones are not known to be plasmid or transposon mediated and presumably are due to mutation(s).

Although the main reservoir for enterococci in humans is the gastrointestinal tract, the bacteria can also reside in the gallbladder, urethra and vagina.

*E. faecalis* has emerged as an important pathogen in endocarditis, bacteremia, urinary tract infections (UTIs), intraabdominal infections, soft tissue infections, and neonatal sepsis. See Lewis et al. (1990) supra. In the 1970s and 1980s enterococci became firmly established as major nosocomial pathogens. They are now the fourth leading cause of hospital-acquired infection and the third leading cause of bacteremia in the United States. Fatality ratios for enterococcal bactermia range from 12% to 68%, with death due to enterococcal sepsis in 4 to 50% of these cases. See T. G. Emori (1993) Clin. Microbiol. Rev. 6:428–442.

The ability of enterococci to colonize the gastrointestinal tract, plus the many intrinsic and acquired resistance traits, means that these organisms, which usually seem to have relatively low intrinsic virulence, are given an excellent opportunity to become secondary invaders. Since nosocomial isolates of enterococci have displayed resistance to essentially every useful antimicrobial agent, it will likely become increasingly difficult to successfully treat and control enterococcal infections. Particularly when the various resistance genes come together in a single strain, an event almost certain to occur at some time in the future.

The etiology of diseases mediated or exacerbated by *Enterococcus faecalis,* involves the programmed expression of *E. faecalis* genes, and that characterizing these genes and their patterns of expression would dramatically add to our understanding of the organism and its host interactions. Knowledge of the *E. faecalis* gene and genomic organization would improve our understanding of disease etiology and lead to improved and new ways of preventing, treating and diagnosing diseases. Thus, there is a need to characterize the genome of *E. faecalis* and for polynucleotides of this organism.

SUMMARY OF THE INVENTION

The present invention provides for isolated *E. faecalis* polynucleotides and polypeptides shown in Table 1 and SEQ ID NO:1 through SEQ ID NO:496 (polynucleotide sequences having odd SEQ ID NOs and polypeptide sequences having even SEQ ID NOs). One aspect of the invention provides isolated nucleic acid molecules comprising polynucleotides having a nucleotide sequence selected from the group consisting of: (a) a nucleotide sequence shown in Table 1; (b) a nucleotide sequence encoding any of the amino acid sequences of the polypeptides shown in Table 1; and (c) a nucleotide sequence complementary to any of the nucleotide sequences in (a) or (b). The invention further provides for fragments of the nucleic acid molecules of (a), (b) & (c) above.

Further embodiments of the invention include isolated nucleic acid molecules that comprise a polynucleotide having a nucleotide sequence at least 90% identical, and more preferably at least 95%, 96%, 97%, 98% or 99% identical, to any of the nucleotide sequences in (a), (b) or (c) above, or a polynucleotide which hybridizes under stringent hybridization conditions to a polynucleotide in (a), (b) or (c) above. Additional nucleic acid embodiments of the invention relate to isolated nucleic acid molecules comprising polynucleotides which encode the amino acid sequences of epitope-bearing portions of a *E. faecalis* polypeptide having an amino acid sequence in (a) above.

The present invention also relates to recombinant vectors, which include the isolated nucleic acid molecules of the present invention, and to host cells containing the recombinant vectors, as well as to methods of making such vectors and host cells. The present invention further relates to the use of these vectors in the production of *E. faecalis* polypeptides or peptides by recombinant techniques.

The invention further provides isolated *E. faecalis* polypeptides having an amino acid sequence selected from the group consisting of an amino acid sequence of any of the polypeptides described in Table 1 or fragments thereof.

The polypeptides of the present invention also include polypeptides having an amino acid sequence with at least 70% similarity, and more preferably at least 75%, 80%, 85%, 90%, 95%, 96%, 97%, 98%, or 99% similarity to those described in Table 1, as well as polypeptides having an amino acid sequence at least 70% identical, more preferably at least 75% identical, and still more preferably 80%, 85%, 90%, 95%, 96%, 97%, 98%, or 99% identical to those above; as well as isolated nucleic acid molecules encoding such polypeptides.

The present invention further provides a single or multi-component vaccine comprising one or more of the *E. faecalis* polynucleotides or polypeptides described in Table 1, or fragments thereof, together with a pharmaceutically acceptable diluent, carrier, or excipient, wherein the *E. faecalis* polypeptide(s) are present in an amount effective to elicit an immune response to members of the Enterococcus genus, or at least *E. faecalis,* in an animal. The *E. faecalis* polypeptides of the present invention may further be combined with one or more immunogens of one or more other Enterococcal or non-Enterococcal organisms to produce a multi-component vaccine intended to elicit an immunological response against members of the Enterococcus genus and, optionally, one or more non-Enterococcal organisms.

The vaccines of the present invention can be administered in a DNA form, e.g., "naked" DNA, wherein the DNA encodes one or more Enterococcal polypeptides and, optionally, one or more polypeptides of a non-Enterococcal organism. The DNA encoding one or more polypeptides may be constructed such that these polypeptides are expressed as fusion proteins.

The vaccines of the present invention may also be administered as a component of a genetically engineered organism or host cell. Thus, a genetically engineered organism or host cell which expresses one or more *E. faecalis* polypeptides may be administered to an animal. For example, such a genetically engineered organism or host cell may contain one or more *E. faecalis* polypeptides of the present invention intracellularly, on its cell surface, or in its periplasmic space. Further, such a genetically engineered organism or host cell may secrete one or more *E. faecalis* polypeptides. The vaccines of the present invention may also be co-administered to an animal with an immune system modulator (e.g., CD86 and GM-CSF).

The invention also provides a method of inducing an immunological response in an animal to one or more members of the Enterococcus genus, preferably one or more isolates of the *E. faecalis* species, comprising administering to the animal a vaccine as described above.

The invention further provides a method of inducing a protective immune response in an animal, sufficient to prevent, attenuate, or control an infection by members of the Enterococcus genus, preferably at least *E. faecalis* species, comprising administering to the animal a composition comprising one or more of the polynucleotides or polypeptides described in Table 1, or fragments thereof. Further, these polypeptides, or fragments thereof, may be conjugated to another immunogen and/or administered in admixture with an adjuvant.

The invention further relates to antibodies elicited in an animal by the administration of one or more *E. faecalis* polypeptides of the present invention and to methods for producing such antibodies and fragments thereof. The invention further relates to recombinant antibodies and fragments thereof and to methods for producing such antibodies and fragments thereof.

The invention also provides diagnostic methods for detecting the expression of the polynucleotides of Table 1 by members of the Enterococcus genus in an animal. One such method involves assaying for the expression of a polynucleotide encoding *E. faecalis* polypeptides in a sample from an animal. This expression may be assayed either directly (e. g., by assaying polypeptide levels using antibodies elicited in response to amino acid sequences described in Table 1) or indirectly (e.g., by assaying to for antibodies having specificity for amino acid sequences described in Table 1). The expression of polynucleotides can also be assayed by detecting the nucleic acids of Table 1. An example of such a method involves the use of the polymerase chain reaction (PCR) to amplify and detect Enterococcus nucleic acid sequences.

The present invention also relates to nucleic acid probes having all or part of a nucleotide sequence described in Table 1 (odd SEQ ID NOs) which are capable of hybridizing under stringent conditions to Enterococcus nucleic acids. The invention further relates to a method of detecting one or more Enterococcus nucleic acids in a biological sample obtained from an animal, said one or more nucleic acids encoding Enterococcus polypeptides, comprising: (a) contacting the sample with one or more of the above-described nucleic acid probes, under conditions such that hybridization occurs, and (b) detecting hybridization of said one or more probes to the Enterococcus nucleic acid present in the biological sample.

Other uses of the polypeptides of the present invention include: inter alia, to detect *E. faecalis* immunoassays, as epitope tags, as molecular weight markers on SDS-PAGE gels, as molecular weight markers for molecular sieve gel filtration columns, to generate antibodies that specificaly bind *E. faecalis* polypeotides of the present invention for the detection *E. faecalis* in immunoassays, to generate an immune response against *E. faecalis* and other Enterococcus species, and as vaccines against *E. faecalis,* other Enterococcus species and other bacteria genuses.

Isolated nucleic acid molecules of the present invention, particularly DNA molecules, are useful as probes for gene mapping and for identifying *E. faecalis* in a biological samples, for instance, by Southern and Northern blot analysis. Polynucleotides of the present invention are also useful in detecting *E. faecalis* by PCR using primers for a particular *E. faecalis* polynucleotide. Isolated polynucleotides of the present invention are also useful in making the polypeptides of the present invention.

DETAILED DESCRIPTION

The present invention relates to recombinant *E. faecalis* nucleic acids and fragments thereof. The present invention further relates to recombinant *E. faecalis* polypeptides and fragments thereof. The invention also relates to methods for using these polypeptides to produce immunological responses and to confer immunological protection to disease caused by members of the genus Enterococcus, at least isolates of the *E. faecalis* genus. The invention further relates to nucleic acid sequences which encode antigenic *E. faecalis* polypeptides and to methods for detecting E faecalis nucleic acids and polypeptides in biological samples. The invention also relates to antibodies specific for the polypeptides and peptides of the present invention and methods for detecting such antibodies produced in a host animal.

Definitions

The following definitions are provided to clarify the subject matter which the inventors consider to be the present invention.

As used herein, the phrase "pathogenic agent" means an agent which causes a disease state or affliction in an animal. Included within this definition, for examples, are bacteria, protozoans, fungi, viruses and metazoan parasites which either produce a disease state or render an animal infected with such an organism susceptible to a disease state (e.g., a secondary infection). Further included are species and strains of the genus Enterococcus which produce disease states in animals.

As used herein, the term "organism" means any living biological system, including viruses, regardless of whether it is a pathogenic agent.

As used herein, the term "Enterococcus" means any species or strain of bacteria which is members of the genus Enterococcus. Such species and strains are known to those of skill in the art, and include those that are pathogenic and those that are not.

As used herein, the phrase "one or more E. faecalis polypeptides of the present invention" means polypeptides comprising the amino acid sequence of one or more of the E. faecalis polypeptides described in Table 1 (even SEQ ID NOs). These polypeptides may be expressed as fusion proteins wherein the E. faecalis polypeptides of the present invention are linked to additional amino acid sequences which may be of Enterococcal or non-Enterococcal origin. This phrase further includes polypeptide comprising fragments of the E. faecalis polypeptides of the present invention. Additional definitions are provided throughout the specification.

Explanation of Table 1

Table 1, below, provides information describing genes which encode polypeptides of E. faecalis. The table lists the gene identifier which consists of the letters EF, which denote E. faecalis, followed immediately by a three digit numeric code, which arbitrarily number the E. faecalis genes of the present invention. A number from 1 through 4 follows the three digit number. A number 1 represents the full length open reading frame of the gene specified by the preceeding three digit number. A number 2 represents the full length polypeptide encoded by the gene specified the preceeding three digit number. A number 3 represents a polynucleotide fragment, of the gene represented by the preceeding three digit number, used to produce an antigenic polypeptide. A number 4 represents an antigenic polypeptide fragment of the gene represented by the preceeding three digit number, used to stimulate an immune response or as a vaccine. The nucleotide and amino acid sequences of each gene and fragment are also shown in the Sequence Listing under the SEQ ID NO listed in Table 1.

Explanation of Table 2

Table 2 lists accession numbers for the closest matching sequences between the polypeptides of the present invention and those available through GenBank and Derwent databases. These reference numbers are the database entry numbers commonly used by those of skill in the art, who will be familar with their denominations. The descriptions of the nomenclature for GenBank are available from the National Center for Biotechnology Information. Column 1 lists the gene or ORF of the present invention. Column 2 lists the accession number of a "match" gene sequence in GenBank or Derwent databases. Column 3 lists the description of the "match" gene sequence. Columns 4 and 5 are the high score and smallest sum probability, respectively, calculated by BLAST. Polypeptides of the present invention that do not share significant identity/similarity with any polypeptide sequences of GenBank and Derwent are not represented in Table 2. Polypeptides of the present invention that share significant identity/similarity with more than one of the polypeptides of GenBank and Derwent are represented more than once.

Explanation of Table 3.

The E. faecalis polypeptides of the present invention may include one or more conservative amino acid substitutions from natural mutations or human manipulation as indicated in Table 3. Changes are preferably of a minor nature, such as conservative amino acid substitutions that do not significantly affect the folding or activity of the protein. Residues from the following groups, as indicated in Table 3, may be substituted for one another: Aromatic, Hydrophobic, Polar, Basic, Acidic, and Small.

Explanation of Table 4

Table 4 lists residues comprising antigenic epitopes of antigenic epitope-bearing fragments present in each of the full length E. faecalis polypeptides described in Table 1 as predicted by the inventors using the algorithm of Jameson and Wolf, (1988) Comp. Appl. Biosci. 4:181–186. The Jameson-Wolf antigenic analysis was performed using the computer program PROTEAN (Version 3.11 for the Power Macintosh, DNASTAR, Inc., 1228 South Park Street Madison, Wis.). E. faecalis polypeptide shown in Table 1 may one or more antigenic epitopes comprising residues described in Table 4. It will be appreciated that depending on the analytical criteria used to predict antigenic determinants, the exact address of the determinant may vary slightly. The residues and locations shown described in Table 4 correspond to the amino acid sequences for each full length gene sequence shown in Table 1 and in the Sequence Listing. Polypeptides of the present invention that do not have antigenic epitopes recognized by the Jameson-Wolf algorithm are not represented in Table 2.

Selection of Nucleic Acid Sequences Encoding Antigenic E. faecalis Polypeptides

Sequenced E. faecalis genomic DNA was obtained from the E. faecalis strain V586. The E. faecalis strain V586 was deposited May 2, 1997 at the ATCC, 10801 University Blvd. Manassas, Va. 20110-2209, and given accession number 55969.

Some ORFs contained in the subset of fragments of the E. faecalis genome disclosed herein were derived through the use of a number of screening criteria detailed below. The ORFs are bounded at the amino terminus by a methionine or valine residue and usually at the carboxy terminus by a stop codon.

Most of the selected sequences consist of complete ORFs. The polypeptides that do not comprise a complete ORF can be determined by determining whether the corresponding polynucleotide sequence comprises a stop codon after the codon for the last amino acid residue in the polypeptide sequence. It is not always preferred to express a complete ORF in a heterologous system. It may be challenging to express and purify a highly hydrophobic protein by common laboratory methods. Some of the polypeptide vaccine candidates described herein have been modified slightly to simplify the production of recombinant protein. For example, nucleotide sequences which encode highly hydrophobic domains, such as those found at the amino terminal signal sequence, have been excluded from some constructs used for expression of the polypeptides. Furthermore, any highly hydrophobic amino acid sequences occurring at the carboxy terminus have also been excluded from the recombinant expression constructs. Thus, in one embodiment, a polypeptide which represents a truncated or modified ORF may be used as an antigen.

While numerous methods are known in the art for selecting potentially immunogenic polypeptides, many of the ORFs disclosed herein were selected on the basis of screening *Enterococcus faecalis* ORFs for several aspects of potential immunogenicity. One set of selection criteria are as follows:

1. Type I signal sequence: An amino terminal type I signal sequence generally directs a nascent protein across the plasma and outer membranes to the exterior of the bacterial cell. Experimental evidence obtained from studies with *Escherichia coli* suggests that the typical type I signal sequence consists of the following biochemical and physical attributes (Izard, J. W. and Kendall, D. A. *Mol. Microbiol.* 13:765–773 (1994)). The length of the type I signal sequence is approximately 15 to 25 primarily hydrophobic amino acid residues with a net positive charge in the extreme amino terminus. In addition, the central region of the signal sequence adopts an alpha-helical conformation in a hydrophobic environment. Finally, the region surrounding the actual site of cleavage is ideally six residues long, with small side-chain amino acids in the −1 and −3 positions.

2. Type IV signal sequence: The type IV signal sequence is an example of the several types of functional signal sequences which exist in addition to the type I signal sequence detailed above. Although functionally related, the type IV signal sequence possesses a unique set of biochemical and physical attributes (Strom, M. S. and Lory, S., *J. Bacteriol.* 174:7345–7351 (1992)). These are typically six to eight amino acids with a net basic charge followed by an additional sixteen to thirty primarily hydrophobic residues. The cleavage site of a type IV signal sequence is typically after the initial six to eight amino acids at the extreme amino terminus. In addition, type IV signal sequences generally contain a phenylalanine residue at the +1 site relative to the cleavage site.

3. Lipoprotein: Studies of the cleavage sites of twenty-six bacterial lipoprotein precursors has allowed the definition of a consensus amino acid sequence for lipoprotein cleavage. Nearly three-fourths of the bacterial lipoprotein precursors examined contained the sequence L—(A,S)—(G,A)—C at positions −3 to +1, relative to the point of cleavage (Hayashi, S. and Wu, H. C., *J. Bioenerg. Biomembr.* 22:451–471 (1990)).

4. LPXTG motif: It has been experimentally determined that most anchored proteins found on the surface of gram-positive bacteria possess a highly conserved carboxy terminal sequence. More than fifty such proteins from organisms such as *S. pyogenes, S. mutans, E. faecalis, S. pneumoniae*, and others, have been identified based on their extracellular location and carboxy terminal amino acid sequence (Fischetti, V. A., *ASM News* 62:405–410 (1996)). The conserved region consists of six charged amino acids at the extreme carboxy terminus coupled to 15–20 hydrophobic amino acids presumed to function as a transmembrane domain. Immediately adjacent to the transmembrane domain is a six amino acid sequence conserved in nearly all proteins examined. The amino acid sequence of this region is L-P-X-T-G-X, where X is any amino acid (SEQ ID NO:497).

An algorithm for selecting antigenic and immunogenic *Enterococcus faecalis* polypeptides including the foregoing criteria was developed. The algorithm is similar to that described in U.S. patent application Ser. No. 08/781,986, filed Jan. 3, 1997, which is fully incorporated by reference herein. Use of the algorithm by the inventors to select immunologically useful *Enterococcus faecalis* polypeptides resulted in the selection of a number of the disclosed ORFs. Polypeptides comprising the polypeptides identified in this group may be produced by techniques standard in the art and as further described herein.

Nucleic Acid Molecules

Sequenced *E. faecalis* genomic DNA was obtained from the *E. faecalis* strain V586. As discussed elsewhere hererin, polynucleotides of the present invention readily may be obtained by routine application of well known and standard procedures for cloning and sequencing DNA. Detailed methods for obtaining libraries and for sequencing are provided below, for instance. A wide variety of *Enterococcus faecalis* strains that can be used to prepare *E. faecalis* genomic DNA for cloning and for obtaining polynucleotides and polypeptides of the present invention. A wide variety of *Enterococcus faecalis* strains are available to the public from recognized depository institutions, such as the American Type Culture Collection (ATCC). It is recognized that minor variation is the nucleic acid and amino acid sequence may be expected from *E. faecalis* strain to strain. The present invention provides for genes, including both polynucleotides and polypeptides, of the of the present invention from all the *Enterococcus faecalis* strains.

Unless otherwise indicated, all nucleotide sequences determined by sequencing a DNA molecule herein were determined using an automated DNA sequencer (such as the Model 373 from Applied Biosystems, Inc., Foster City, Calif.), and all amino acid sequences of polypeptides encoded by DNA molecules determined herein were predicted by translation of a DNA sequence determined as above. Therefore, as is known in the art for any DNA sequence determined by this automated approach, any nucleotide sequence determined herein may contain some errors. Nucleotide sequences determined by automation are typically at least about 90% identical, more typically at least about 95% to at least about 99.9% identical to the actual nucleotide sequence of the sequenced DNA molecule. The actual sequence can be more precisely determined by other approaches including manual DNA sequencing methods well known in the art. As is also known in the art, a single insertion or deletion in a determined nucleotide sequence compared to the actual sequence will cause a frame shift in translation of the nucleotide sequence such that the predicted amino acid sequence encoded by a determined nucleotide sequence will be completely different from the amino acid sequence actually encoded by the sequenced DNA molecule, beginning at the point of such an insertion or deletion. In case of conflict between Table 1 and either the nucleic acid sequence of the clones listed in Table 1 or the amino acid sequence of the protein expressed by the clones listed in Table 1, the clones listed in Table 1 are controlling. By "nucleotide sequence" of a nucleic acid molecule or polynucleotide is intended to mean either a DNA or RNA sequence. Using the information provided herein, such as the nucleotide sequence in Table 1, a nucleic acid molecule of the present invention encoding a *E. faecalis* polypeptide may be obtained using standard cloning and screening procedures, such as those for cloning DNAs using genomic DNA as starting material. See, e.g., Sambrook et al. MOLECULAR CLONING: A LABORATORY MANUAL (Cold Spring Harbor, N.Y. 2nd ed. 1989); Ausubel et al., CURRENT PROTOCOLS IN MOLECULAR BIOLOGY (John Wiley and Sons, N.Y. 1989). Illustrative of the invention, the nucleic acid molecule described in Table 1 was discovered in a DNA library derived from a *E. faecalis* genomic DNA.

Nucleic acid molecules of the present invention may be in the form of RNA, such as mRNA, or in the form of DNA, including, for instance, DNA and genomic DNA obtained by cloning or produced synthetically. The DNA may be double-stranded or single-stranded. Single-stranded DNA or RNA may be the coding strand, also known as the sense strand, or it may be the non-coding strand, also referred to as the anti-sense strand.

By "isolated" nucleic acid molecule(s) is intended a nucleic acid molecule, DNA or RNA, which has been removed from its native environment. This includes segments of DNA comprising the *E. faecalis* polynucleotides of the present invention isolated from the native chromosome. These fragments include both isolated fragments consisting only of *E. faecalis* DNA and fragments comprising heterologous sequences such as vector sequences or other foreign DNA. For example, recombinant DNA molecules contained in a vector are considered isolated for the purposes of the present invention. Further examples of isolated DNA molecules include recombinant DNA molecules maintained in heterologous host cells or purified partially or substantially) DNA molecules in solution. Isolated RNA molecules include in vivo or in vitro RNA transcripts of the DNA molecules of the present invention. Isolated nucleic acid molecules according to the present invention further include such molecules produced synthetically.

In addition, isolated nucleic acid molecules of the invention include DNA molecules which comprise a sequence substantially different from those described above but which, due to the degeneracy of the genetic code, still encode a *E. faecalis* polypeptides and peptides of the present invention (e.g. polypeptides of Table 1). That is, all possible DNA sequences that encode the *E. faecalis* polypeptides of the present invention. This includes the genetic code and species-specific codon preferences known in the art. Thus, it would be routine for one skilled in the art to generate the degenerate variants described above, for instance, to optimize codon expression for a particular host (e.g., change codons in the bacteria mRNA to those preferred by a mammalian or other bacterial host such as *E. coli*).

The invention further provides isolated nucleic acid molecules having the nucleotide sequence shown in Table 1 or a nucleic acid molecule having a sequence complementary to one of the above sequences. Such isolated molecules, particularly DNA molecules, are useful as probes for gene mapping and for identifying *E. faecalis* in a biological sample, for instance, by PCR, Southern blot, Northern blot, or other form of hybridization analysis.

The present invention is further directed to nucleic acid molecules encoding portions or fragments of the nucleotide sequences described herein. Fragments include portions of the nucleotide sequences of Table 1, or the *E. faecalis* nucleotide sequences contained in the plasimd clones listed in Table 1, at least 10 contiguous nucleotides in length selected from any two integers, one of which representing a 5' nucleotide position and a second of which representing a 3' nucleotide position, where the first nucleotide for each nucleotide sequence in Table 1 is position 1. That is, every combination of a 5' and 3' nucleotide position that a fragment at least 10 contiguous nucleotides in length could occupy is included in the invention. At least means a fragment may be 10 contiguous nucleotide bases in length or any integer between 10 and the length of an entire nucleotide sequence of Table 1 minus 1. Therefore, included in the invention are contiguous fragments specified by any 5' and 3' nucleotide base positions of a nucleotide sequences of Table 1 wherein the contiguous fragment is any integer between 10 and the length of an entire nucleotide sequence minus 1.

Further, the invention includes polynucleotides comprising fragments specified by size, in nucleotides, rather than by nucleotide positions. The invention includes any fragment size, in contiguous nucleotides, selected from integers between 10 and the length of an entire nucleotide sequence minus 1. Preferred sizes of contiguous nucleotide fragments include 20 nucleotides, 30 nucleotides, 40 nucleotides, 50 nucleotides. Other preferred sizes of contiguous nucleotide fragments, which may be useful as diagnostic probes and primers, include fragments 50–300 nucleotides in length which include, as discussed above, fragment sizes representing each integer between 50–300. Larger fragments are also useful according to the present invention corresponding to most, if not all, of the nucleotide sequences shown in Table 1 or of the *E. faecalis* nucleotide sequences of the plasimd clones listed in Table. 1. The preferred sizes are, of course, meant to exemplify not limit the present invention as all size fragments, representing any integer between 10 and the length of an entire nucleotide sequence minus 1, are included in the invention. Additional preferred nucleic acid fragments of the present invention include nucleic acid molecules encoding epitope-bearing portions of *E. faecalis* polypeptides identified in Table 4.

The present invention also provides for the exclusion of any fragment, specified by 5' and 3' base positions or by size in nucleotide bases as described above for any nucleotide sequence of Table 1 or the plasimd clones listed in Table 1. Any number of fragments of nucleotide sequences in Table 1 or the plasmid clones listed in Table 1, specified by 5' and 3' base positions or by size in nucleotides, as described above, may be excluded from the present invention.

In another aspect, the invention provides an isolated nucleic acid molecule comprising a polynucleotide which hybridizes under stringent hybridization conditions to a portion of a polynucleotide in a nucleic acid molecules of the invention described above, for instance, nucleotide sequences of Table 1 or the *E. faecalis* sequences of the plasimd clones listed in Table 1. By "stringent hybridization conditions" is intended overnight incubation at 42° C. in a solution comprising: 50% formamide, 5×SSC phosphate (pH 7.6), 5×Denhardt's solution, 10% dextran sulfate, and 20 μg/ml denatured, sheared salmon sperm DNA, followed by washing the filters in 0.1×SSC at about 65° C.

By a polynucleotide which hybridizes to a "portion" of a polynucleotide is intended a polynucleotide (either DNA or RNA) hybridizing to at least about 15 nucleotides bases, and more preferably at least about 20 nucleotides bases, still more preferably at least about 30 nucleotides bases, and even more preferably about 30–70 (e.g., 50) nucleotides bases of the reference polynucleotide. These are useful as diagnostic probes and primers as discussed above. By a portion of a polynucleotide of "at least 20 nucleotides bases in length," for example, is intended 20 or more contiguous nucleotides bases nucleotides from the nucleotide sequence of the reference polynucleotide (e.g., the nucleotide sequence as shown in Table 1). Portions of a polynucleotide which hybridizes to a nucleotide sequence in Table 1, which can be used as probes and primers, may also be precisely specified by 5' and 3' base positions or by size in nucleotide bases as described above or precisely excluded in the same manner.

The nucleic acid molecules of the present invention include those encoding the full length *E. faecalis* polypeptides of Table 1 and portions of the *E. faecalis* polypeptides of Table 1. Also included in the present invention are nucleic acids encoding the above full length sequences and further comprise additional sequences, such as those encoding an added secretory leader sequence, such as a pre-, or pro- or prepro-protein sequence. Further included in the present invention are nucleic acids encoding the above full length sequences and portions thereof and further comprise additional heterologous amino acid sequences encoded by nucleic acid sequences from a different source.

Also included in the present invention are nucleic acids encoding the above protein sequences together with additional, non-coding sequences, including for example, but not limited to non-coding 5' and 3' sequences. These sequences include transcribed, non-translated sequences that may play a role in transcription, and mRNA processing, for example, ribosome binding and stability of mRNA. Also included in the present invention are additional coding sequences which provide additional functionalities.

Thus, a nucleotide sequence encoding a polypeptide may be fused to a marker sequence, such as a sequence encoding a peptide which facilitates purification of the fused polypeptide. In certain preferred embodiments of this aspect of the invention, the marker amino acid sequence is a hexahistidine peptide, such as the tag provided in a pQE vector (QIAGEN, Inc., 9259 Eton Avenue, Chatsworth, Calif., 91311), among others, many of which are commercially available. For instance, hexa-histidine provides for convenient purification of the fusion protein. See Gentz et al. (1989) Proc. Natl. Acad. Sci. 86:821–24. The "HA" tag is another peptide useful for purification which corresponds to an epitope derived from the influenza hemagglutinin protein. See Wilson et al. (1984) Cell 37:767. As discussed below, other such fusion proteins include the *E. faecalis* polypeptides of the present invention fused to Fc at the N- or C-terminus.

Variant and Mutant Polynucleotides

The present invention further relates to variants of the nucleic acid molecules which encode portions, analogs or derivatives of a *E. faecalis* polypeptides of Table 1 and variant polypeptides thereof including portions, analogs, and derivatives of the *E. faecalis* polypeptides. Variants may occur naturally, such as a natural allelic variant. By an "allelic variant" is intended one of several alternate forms of a gene occupying a given locus on a chromosome of an organism. See, e.g., B. Lewin, Genes IV (1990). Non-naturally occurring variants may be produced using art-known mutagenesis techniques.

Such nucleic acid variants include those produced by nucleotide substitutions, deletions, or additions. The substitutions, deletions, or additions may involve one or more nucleotides. The variants may be altered in coding regions, non-coding regions, or both. Alterations in the coding regions may produce conservative or non-conservative amino acid substitutions, deletions or additions. Especially preferred among these are silent substitutions, additions and deletions, which do not alter the properties and activities of a *E. faecalis* protein of the present invention or portions thereof. Also especially preferred in this regard are conservative substitutions.

Such polypeptide variants include those produced by amino acid substitutions, deletions or additions. The substitutions, deletions, or additions may involve one or more residues. Alterations may produce conservative or non-conservative amino acid substitutions, deletions, or additions. Especially preferred among these are silent substitutions, additions and deletions, which do not alter the properties and activities of a *E. faecalis* protein of the present invention or portions thereof. Also especially preferred in this regard are conservative substitutions.

The present invention also relates to recombinant vectors, which include the isolated nucleic acid molecules of the present invention, and to host cells containing the recombinant vectors, as well as to methods of making such vectors and host cells and for using them for production of *E. faecalis* polypeptides or peptides by recombinant techniques.

The present application is directed to nucleic acid molecules at least 90%, 95%, 96%, 97%, 98% or 99% identical to a nucleic acid sequence shown in Table 1. The above nucleic acid sequences are included irrespective of whether they encode a polypeptide having *E. faecalis* activity. This is because even where a particular nucleic acid molecule does not encode a polypeptide having *E. faecalis* activity, one of skill in the art would still know how to use the nucleic acid molecule, for instance, as a hybridization probe. Uses of the nucleic acid molecules of the present invention that do not encode a polypeptide having *E. faecalis* activity include, inter alia, isolating an *E. faecalis* gene or allelic variants thereof from a DNA library, and detecting *E. faecalis* mRNA expression samples, environmental samples, suspected of containing *E. faecalis* by Northern Blot analysis.

Preferred, are nucleic acid molecules having sequences at least 90%, 95%, 96%, 97%, 98% or 99% identical to the nucleic acid sequence shown in Table 1, which do, in fact, encode a polypeptide having *E. faecalis* protein activity By "a polypeptide having *E. faecalis* activity" is intended polypeptides exhibiting activity similar, but not necessarily identical, to an activity of the *E. faecalis* protein of the invention, as measured in a particular biological assay suitable for measuring activity of the specified protein.

Due to the degeneracy of the genetic code, one of ordinary skill in the art will immediately recognize that a large number of the nucleic acid molecules having a sequence at least 90%, 95%, 96%, 97%, 98%, or 99% identical to the nucleic acid sequences shown in Table 1 will encode a polypeptide having *E. faecalis* protein activity. In fact, since degenerate variants of these nucleotide sequences all encode the same polypeptide, this will be clear to the skilled artisan even without performing the above described comparison assay. It will be further recognized in the art that, for such nucleic acid molecules that are not degenerate variants, a reasonable number will also encode a polypeptide having *E. faecalis* protein activity. This is because the skilled artisan is fully aware of amino acid substitutions that are either less likely or not likely to significantly effect protein function (e.g., replacing one aliphatic amino acid with a second aliphatic amino acid), as further described below.

The biological activity or function of the polypeptides of the present invention are expected to be similar or identical to polypeptides from other bacteria that share a high degree of structural identity/similarity. Tables 2 lists accession numbers and descriptions for the closest matching sequences of polypeptides available through Genbank and Derwent databases. It is therefore expected that the biological activity or function of the polypeptides of the present invention will be similar or identical to those polypeptides from other bacterial genuses, species, or strains listed in Table 2.

By a polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence encoding the *E. faecalis* polypeptide. In other words, to obtain a polynucleotide having a nucleotide sequence at least 95% identical to a reference nucleotide sequence, up to 5% of the nucleotides in the reference sequence may be deleted, inserted, or substituted with another nucleotide. The query sequence may be an entire sequence shown in Table 1, the ORF (open reading frame), or any fragment specified as described herein.

As a practical matter, whether any particular nucleic acid molecule or polypeptide is at least 90%, 95%, 96%, 97%, 98% or 99% identical to a nucleotide sequence of the presence invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al. See Brutlag et al. (1990) Comp. App. Biosci. 6:237–245. In a sequence alignment the query and subject sequences are both DNA sequences. An RNA sequence can be compared by first converting U's to T's. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the lenght of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only nucleotides outside the 5' and 3' nucleotides of the subject sequence, as displayed by the FASTDB alignment, which are not matched/aligned with the query sequence, are calculated for the purposes of manually adjusting the percent identity score.

For example, a 90 nucleotide subject sequence is aligned to a 100 nucleotide query sequence to determine percent identity. The deletions occur at the 5' end of the subject sequence and therefore, the FASTDB alignment does not show a matched/alignment of the first 10 nucleotides at 5' end. The 10 unpaired nucleotides represent 10% of the sequence (number of nucleotides at the 5' and 3' ends not matched/total number of nucleotides in the query sequence) so 10% is subtracted from the percent identity score calculated by the FASTDB program. If the remaining 90 nucleotides were perfectly matched the final percent identity would be 90%. In another example, a 90 nucleotide subject sequence is compared with a 100 nucleotide query sequence. This time the deletions are internal deletions so that there are no nucleotides on the 5' or 3' of the subject sequence which are not matched/aligned with the query. In this case the percent identity calculated by FASTDB is not manually corrected. Once again, only nucleotides 5' and 3' of the subject sequence which are not matched/aligned with the query sequence are manually corrected for. No other manual corrections are to made for the purposes of the present invention.

Vectors and Host Cell

The present invention also relates to vectors which include the isolated DNA molecules of the present invention, host cells comprising the recombinant vectors, and the production of *E. faecalis* polypeptides and peptides of the present invention expressed by the host cells.

Recombinant constructs may be introduced into host cells using well known techniques such as infection, transduction, transfection, transvection, electroporation and transformation. The vector may be, for example, a phage, plasmid, viral or retroviral vector. Retroviral vectors may be replication competent or replication defective. In the latter case, viral propagation generally will occur only in complementing host cells.

The polynucleotides may be joined to a vector containing a selectable marker for propagation in a host. Generally, a plasmid vector is introduced in a precipitate, such as a calcium phosphate precipitate, or in a complex with a charged lipid. If the vector is a virus, it may be packaged in vitro using an appropriate packaging cell line and then transduced into host cells.

Preferred are vectors comprising cis-acting control regions to the polynucleotide of interest. Appropriate transacting factors may be supplied by the host, supplied by a complementing vector or supplied by the vector itself upon introduction into the host.

In certain preferred embodiments in this regard, the vectors provide for specific expression, which may be inducible and/or cell type-specific. Particularly preferred among such vectors are those inducible by environmental factors that are easy to manipulate, such as temperature and nutrient additives.

Expression vectors useful in the present invention include chromosomal-, episomal- and virus-derived vectors, e g, vectors derived from bacterial plasmids, bacteriophage, yeast episomes, yeast chromosomal elements, viruses such as baculoviruses, papova viruses, vaccinia viruses, adenoviruses, fowl pox viruses, pseudorabies viruses and retroviruses, and vectors derived from combinations thereof, such as cosmids and phagemids.

The DNA insert should be operatively linked to an appropriate promoter, such as the phage lambda PL promoter, the *E. coli* lac, trp and tac promoters, the SV40 early and late promoters and promoters of retroviral LTRs, to name a few. Other suitable promoters will be known to the skilled artisan. The expression constructs will further contain sites for transcription initiation, termination and, in the transcribed region, a ribosome binding site for translation. The coding portion of the mature transcripts expressed by the constructs will preferably include a translation initiating site at the beginning and a termination codon (UAA, UGA or UAG) appropriately positioned at the end of the polypeptide to be translated.

As indicated, the expression vectors will preferably include at least one selectable marker. Such markers include dihydrofolate reductase or neomycin resistance for eukaryotic cell culture and tetracycline, kanamycin, or ampicillin resistance genes for culturing in *E. coli* and other bacteria.

Representative examples of appropriate hosts include, but are not limited to, bacterial cells, such as *E. coli,* Streptomyces and *Salmonella typhimurium* cells; fungal cells, such as yeast cells; insect cells such as Drosophila S2 and Spodoptera Sf9 cells; animal cells such as CHO, COS and Bowes melanoma cells; and plant cells. Appropriate culture mediums and conditions for the above-described host cells are known in the art.

Among vectors preferred for use in bacteria include pQE70, pQE60 and pQE9, pQE10 available from Qiagen; pBS vectors, Phagescript vectors, Bluescript vectors, pNH8A, pNH16a, pNH18A, pNH46A available from Stratagene; pET series of vectors available from Novagen; and ptrc99a, pKK223-3, pKK233–3, pDR540, pRIT5 available from Pharmacia. Among preferred eukaryotic vectors are pWLNEO, pSV2CAT, pOG44, pXT1 and pSG available from Stratagene; and pSVK3, pBPV, PMSG and pSVL available from Pharmacia. Other suitable vectors will be readily apparent to the skilled artisan.

Among known bacterial promoters suitable for use in the present invention include the *E. coli* lacI and lacZ promoters, the T3, T5 and T7 promoters, the gpt promoter, the lambda PR and PL promoters and the trp promoter. Suitable eukaryotic promoters include the CMV immediate early promoter, the HSV thymidine kinase promoter, the early and late SV40 promoters, the promoters of retroviral LTRs, such as those of the Rous sarcoma virus (RSV), and metallothionein promoters, such as the mouse metallothionein-I promoter.

Introduction of the construct into the host cell can be effected by calcium phosphate transfection, DEAE-dextran mediated transfection, cationic lipid-mediated transfection, electroporation, transduction, infection or other methods. Such methods are described in many standard laboratory manuals (for example, Davis, et al., *Basic Methods In Molecular Biology* (1986)).

Transcription of DNA encoding the polypeptides of the present invention by higher eukaryotes may be increased by inserting an enhancer sequence into the vector. Enhancers are cis-acting elements of DNA, usually about from 10 to 300 nucleotides that act to increase transcriptional activity of a promoter in a given host cell-type. Examples of enhancers include the SV40 enhancer, which is located on the late side of the replication origin at nucleotides 100 to 270, the cytomegalovirus early promoter enhancer, the polyoma enhancer on the late side of the replication origin, and adenovirus enhancers.

For secretion of the translated polypeptide into the lumen of the endoplasmic reticulum, into the periplasmic space or into the extracellular environment, appropriate secretion signals may be incorporated into the expressed polypeptide, for example, the amino acid sequence KDEL. The signals may be endogenous to the polypeptide or they may be heterologous signals.

The polypeptide may be expressed in a modified form, such as a fusion protein, and may include not only secretion signals, but also additional heterologous functional regions. For instance, a region of additional amino acids, particularly charged amino acids, may be added to the N-terminus of the polypeptide to improve stability and persistence in the host cell, during purification, or during subsequent handling and storage. Also, peptide moieties may be added to the polypeptide to facilitate purification. Such regions may be removed prior to final preparation of the polypeptide. The addition of peptide moieties to polypeptides to engender secretion or excretion, to improve stability and to facilitate purification, among others, are familiar and routine techniques in the art.

A preferred fusion protein comprises a heterologous region from immunoglobulin that is useful to solubilize proteins. For example, EP-A-O 464 533 (Canadian counterpart 2045869) discloses fusion proteins comprising various portions of constant region of immunoglobulin molecules together with another human protein or part thereof. In many cases, the Fc part in a fusion protein is thoroughly advantageous for use in therapy and diagnosis and thus results, for example, in improved pharmacokinetic properties (EP-A 0232 262). On the other hand, for some uses it would be desirable to be able to delete the Fc part after the fusion protein has been expressed, detected and purified in the advantageous manner described. This is the case when Fc portion proves to be a hindrance to use in therapy and diagnosis, for example when the fusion protein is to be used as antigen for immunizations. In drug discovery, for example, human proteins, such as, hIL5-receptor has been fused with Fc portions for the purpose of high-throughput screening assays to identify antagonists of hIL-5. See Bennett, D. et al. (1995) J. Molec. Recogn. 8:52–58 and Johanson, K. et al. (1995) J. Biol. Chem. 270 (16):9459–9471.

The *E. faecalis* polypeptides can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography, lectin chromatography and high performance liquid chromatography ("HPLC") is employed for purification. Polypeptides of the present invention include naturally purified products, products of chemical synthetic procedures, and products produced by recombinant techniques from a prokaryotic or eukaryotic host, including, for example, bacterial, yeast, higher plant, insect and mammalian cells.

Polypeptides and Fragments

The invention further provides an isolated *E. faecalis* polypeptide having an amino acid sequence in Table 1, or a peptide or polypeptide comprising a portion of the above polypeptides.

Variant and Mutant Polypeptides

To improve or alter the characteristics of *E. faecalis* polypeptides of the present invention, protein engineering may be employed. Recombinant DNA technology known to those skilled in the art can be used to create novel mutant proteins or muteins including single or multiple amino acid substitutions, deletions, additions, or fusion proteins. Such modified polypeptides can show, e.g., enhanced activity or increased stability. In addition, they may be purified in higher yields and show better solubility than the corresponding natural polypeptide, at least under certain purification and storage conditions.

N-Terminal and C-Terminal Deletion Mutants

It is known in the art that one or more amino acids may be deleted from the N-terminus or C-terminus without substantial loss of biological function. For instance, Ron et al. J. Biol. Chem., 268:2984–2988 (1993), reported modified KGF proteins that had heparin binding activity even if 3, 8, or 27 N-terminal amino acid residues were missing. Accordingly, the present invention provides polypeptides having one or more residues deleted from the amino terminus of the amino acid sequence of the *E. faecalis* polypeptides shown in Table 1, and polynucleotides encoding such polypeptides.

Similarly, many examples of biologically functional C-terminal deletion muteins are known. For instance, Interferon gamma shows up to ten times higher activities by deleting 8–10 amino acid residues from the carboxy terminus of the protein See, e.g., Dobeli, et al. (1988) J. Biotechnology 7:199–216. Accordingly, the present invention provides polypeptides having one or more residues from the carboxy terminus of the amino acid sequence of the *E. faecalis* polypeptides shown in Table 1. The invention also provides polypeptides having one or more amino acids deleted from both the amino and the carboxyl termini as described below.

The present invention is further directed to polynucleotide encoding portions or fragments of the amino acid sequences described herein as well as to portions or fragments of the isolated amino acid sequences described herein. Fragments include portions of the amino acid sequences of Table 1, are at least 5 contiguous amino acid in length, are selected from any two integers, one of which representing a N-terminal position. The initiation codon of the polypeptides of the present inventions position 1. Every combination of a N-terminal and C-terminal position that a fragment at least 5 contiguous amino acid residues in length could occupy, on any given amino acid sequence of Table 1 is included in the invention. At least means a fragment may be 5 contiguous amino acid residues in length or any integer between 5 and the number of residues in a full length amino acid sequence minus 1. Therefore, included in the invention are contiguous fragments specified by any N-terminal and C-terminal positions of amino acid sequence set forth in Table 1 wherein the contiguous fragment is any integer between 5 and the number of residues in a full length sequence minus 1.

Further, the invention includes polypeptides comprising fragments specified by size, in amino acid residues, rather than by N-terminal and C-terminal positions. The invention includes any fragment size, in contiguous amino acid residues, selected from integers between 5 and the number of residues in a full length sequence minus 1. Preferred sizes of contiguous polypeptide fragments include about 5 amino acid residues, about 10 amino acid residues, about 20 amino acid residues, about 30 amino acid residues, about 40 amino acid residues, about 50 amino acid residues, about 100 amino acid residues, about 200 amino acid residues, about 300 amino acid residues, and about 400 amino acid residues. The preferred sizes are, of course, meant to exemplify, not limit, the present invention as all size fragments representing any integer between 5 and the number of residues in a full length sequence minus 1 are included in the invention. The present invention also provides for the exclusion of any fragments specified by N-terminal and C-terminal positions or by size in amino acid residues as described above. Any number of fragments specified by N-terminal and C-terminal positions or by size in amino acid residues as described above may be excluded.

The above fragments need not be active since they would be useful, for example, in immunoassays, in epitope mapping, epitope tagging, to generate antibodies to a particular portion of the protein, as vaccines, and as molecular weight markers.

Other Mutants

In addition to N- and C-terminal deletion forms of the protein discussed above, it also will be recognized by one of ordinary skill in the art that some amino acid sequences of the *E. faecalis* polypeptide can be varied without significant effect of the structure or function of the protein. If such differences in sequence are contemplated, it should be remembered that there will be critical areas on the protein which determine activity.

Thus, the invention further includes variations of the *E. faecalis* polypeptides which show substantial *E. faecalis* polypeptide activity or which include regions of *E. faecalis* protein such as the protein portions discussed below. Such mutants include deletions, insertions, inversions, repeats, and type substitutions selected according to general rules known in the art so as to have little effect on activity. For example, guidance concerning how to make phenotypically silent amino acid substitutions is provided. There are two main approaches for studying the tolerance of an amino acid sequence to change. See, Bowie, J. U. et al. (1990), Science 247:1306–1310. The first method relies on the process of evolution, in which mutations are either accepted or rejected by natural selection. The second approach uses genetic engineering to introduce amino acid changes at specific positions of a cloned gene and selections or screens to identify sequences that maintain functionality.

These studies have revealed that proteins are surprisingly tolerant of amino acid substitutions. The studies indicate which amino acid changes are likely to be permissive at a certain position of the protein. For example, most buried amino acid residues require nonpolar side chains, whereas few features of surface side chains are generally conserved. Other such phenotypically silent substitutions are described by Bowie et al. (supra) and the references cited therein. Typically seen as conservative substitutions are the replacements, one for another, among the aliphatic amino acids Ala, Val, Leu and Ile; interchange of the hydroxyl residues Ser and Thr, exchange of the acidic residues Asp and Glu, substitution between the amide residues Asn and Gln, exchange of the basic residues Lys and Arg and replacements among the aromatic residues Phe, Tyr.

Thus, the fragment, derivative, analog, or homolog of the polypeptide of Table 1, or that encoded by the plaimds listed in Table 1, may be: (i) one in which one or more of the amino acid residues are substituted with a conserved or non-conserved amino acid residue (preferably a conserved amino acid residue) and such substituted amino acid residue may or may not be one encoded by the genetic code: or (ii) one in which one or more of the amino acid residues includes a substituent group: or (iii) one in which the *E. faecalis* polypeptide is fused with another compound, such as a compound to increase the half-life of the polypeptide (for example, polyethylene glycol): or (iv) one in which the additional amino acids are fused to the above form of the polypeptide, such as an IgG Fc fusion region peptide or leader or secretory sequence or a sequence which is employed for purification of the above form of the polypeptide or a proprotein sequence. Such fragments, derivatives and analogs are deemed to be within the scope of those skilled in the art from the teachings herein.

Thus, the *E. faecalis* polypeptides of the present invention may include one or more amino acid substitutions, deletions, or additions, either from natural mutations or human manipulation. As indicated, changes are preferably of a minor nature, such as conservative amino acid substitutions that do not significantly affect the folding or activity of the protein (see Table 3).

Amino acids in the *E. faecalis* proteins of the present invention that are essential for function can be identified by methods known in the art, such as site-directed mutagenesis or alanine-scanning mutagenesis. See, e.g., Cunningham et al. (1989) Science 244:1081–1085. The latter procedure introduces single alanine mutations at every residue in the molecule. The resulting mutant molecules are then tested for biological activity using assays appropriate for measuring the function of the particular protein.

Of special interest are substitutions of charged amino acids with other charged or neutral amino acids which may produce proteins with highly desirable improved characteristics, such as less aggregation. Aggregation may not only reduce activity but also be problematic when preparing pharmaceutical formulations, because aggregates can be immunogenic. See, e.g., Pinckard et al., (1967) Clin. Exp. Immunol. 2:331–340; Robbins, et al., (1987) Diabetes 36:838–845; Cleland, et al., (1993) Crit. Rev. Therapeutic Drug Carrier Systems 10:307–377.

The polypeptides of the present invention are preferably provided in an isolated form, and preferably are substantially purified. A recombinantly produced version of the *E. faecalis* polypeptide can be substantially purified by the one-step method described by Smith et al. (1988) Gene 67:31–40. Polypeptides of the invention also can be purified from natural or recombinant sources using antibodies directed against the polypeptides of the invention in methods which are well known in the art of protein purification.

The invention further provides for isolated *E. faecalis* polypeptides comprising an amino acid sequence selected from the group consisting of: (a) the amino acid sequence of a full-length *E. faecalis* polypeptide having the complete amino acid sequence shown in Table 1; (b) the amino acid sequence of a full-length *E. faecalis* polypeptide having the complete amino acid sequence shown in Table 1 excepting the N-terminal methionine; (c) the complete amino acid sequence encoded by the plaimds listed in Table 1; and (d) the complete amino acid sequence excepting the N-terminal methionine encoded by the plaimds listed in Table 1. The polypeptides of the present invention also include polypeptides having an amino acid sequence at least 80% identical, more preferably at least 90% identical, and still more preferably 95%, 96%, 97%, 98% or 99% identical to those described in (a), (b), (c), and (d) above.

Further polypeptides of the present invention include polypeptides which have at least 90% similarity, more preferably at least 95% similarity, and still more preferably at least 96%, 97%, 98% or 99% similarity to those described above.

A further embodiment of the invention relates to a polypeptide which comprises the amino acid sequence of a *E. faecalis* polypeptide having an amino acid sequence which contains at least one conservative amino acid substitution, but not more than 50 conservative amino acid substitutions, not more than 40 conservative amino acid substitutions, not more than 30 conservative amino acid substitutions, and not more than 20 conservative amino acid substitutions. Also provided are polypeptides which comprise the amino acid sequence of a *E. faecalis* polypeptide, having at least one, but not more than 10, 9, 8, 7, 6, 5, 4, 3, 2 or 1 conservative amino acid substitutions.

By a polypeptide having an amino acid sequence at least, for example, 95% "identical" to a query amino acid sequence of the present invention, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, (indels) or substituted with another amino acid. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 90%, 95%, 96%, 97%, 98% or 99% identical to, for instance, the amino acid sequences shown in Table 1 or to the amino acid sequence encoded by the plaimds listed in Table 1 can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al., (1990) Comp. App. Biosci. 6:237–245. In a sequence alignment the query and subject sequences are both amino acid sequences. The result of said global sequence alignment is in percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, the results, in percent identity, must be manually corrected. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present invention. Only residues to the N- and C-termini of the subject sequence, which are not matched/aligned with the query sequence, are considered for the purposes of manually adjusting the percent identity score. That is, only query amino acid residues outside the farthest N- and C-terminal residues of the subject sequence.

For example, a 90 amino acid residue subject sequence is aligned with a 100 residue query sequence to determine percent identity. The deletion occurs at the N-terminus of the subject sequence and therefore, the FASTDB alignment does not match/align with the first 10 residues at the N-terminus. The 10 unpaired residues represent 10% of the sequence (number of residues at the N- and C- termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected. No other manual corrections are to made for the purposes of the present invention.

The above polypeptide sequences are included irrespective of whether they have their normal biological activity.

This is because even where a particular polypeptide molecule does not have biological activity, one of skill in the art would still know how to use the polypeptide, for instance, as a vaccine or to generate antibodies. Other uses of the polypeptides of the present invention that do not have *E. faecalis* activity include, inter alia, as epitope tags, in epitope mapping, and as molecular weight markers on SDS-PAGE gels or on molecular sieve gel filtration columns using methods known to those of skill in the art.

As described below, the polypeptides of the present invention can also be used to raise polyclonal and monoclonal antibodies, which are useful in assays for detecting *E. faecalis* protein expression or as agonists and antagonists capable of enhancing or inhibiting *E. faecalis* protein function. Further, such polypeptides can be used in the yeast two-hybrid system to "capture" *E. faecalis* protein binding proteins which are also candidate agonists and antagonists according to the present invention. See, e.g., Fields et al. (1989) Nature 340:245–246.

Epitope-Bearing Portions

In another aspect, the invention provides peptides and polypeptides comprising epitope-bearing portions of the *E. faecalis* polypeptides of the present invention. These epitopes are immunogenic or antigenic epitopes of the polypeptides of the present invention. An "immunogenic epitope" is defined as a part of a protein that elicits an antibody response when the whole protein or polypeptide is the immunogen. These immunogenic epitopes are believed to be confined to a few loci on the molecule. On the other hand, a region of a protein molecule to which an antibody can bind is defined as an "antigenic determinant" or "antigenic epitope." The number of immunogenic epitopes of a protein generally is less than the number of antigenic epitopes. See, e.g., Geysen, et al. (1983) Proc. Natl. Acad. Sci. USA 81:3998–4002. Predicted antigenic epitopes are shown in Table 4, below. It is pointed out that Table 4 only lists amino acid residues comprising epitopes predicted to have the highest degree of antigenicity. The polypeptides not listed in Table 4 and portions of polypeptides not listed in Table 4 are not considered non-antigenic. This is because they may still be antigenic in vivo but merely not recognized as such by the particular algorithm used. Thus, Table 4 lists the amino acid residues comprising preferred antigenic epitopes but not a complete list. Amino acid residues comprising other anigenic epitopes may be determined by algorithms similar to the Jameson-Wolf analysis or by in vivo testing for an antigenic response using the methods described herein or those known in the art.

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, e.g., Sutcliffe, et al., (1983) Science 219:660–666. Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals. Peptides that are extremely hydrophobic and those of six or fewer residues generally are ineffective at inducing antibodies that bind to the mimicked protein; longer, peptides, especially those containing proline residues, usually are effective. See, Sutcliffe, et al., supra, p. 661. For instance, 18 of 20 peptides designed according to these guidelines, containing 8–39 residues covering 75% of the sequence of the influenza virus hemagglutinin HA1 polypeptide chain, induced antibodies that reacted with the HA1 protein or intact virus; and 12/12 peptides from the MuLV polymerase and 18/18 from the rabies glycoprotein induced antibodies that precipitated the respective proteins.

Antigenic epitope-bearing peptides and polypeptides of the invention are therefore useful to raise antibodies, including monoclonal antibodies, that bind specifically to a polypeptide of the invention. Thus, a high proportion of hybridomas obtained by fusion of spleen cells from donors immunized with an antigen epitope-bearing peptide generally secrete antibody reactive with the native protein. See Sutcliffe, et al., supra, p. 663. The antibodies raised by antigenic epitope-bearing peptides or polypeptides are useful to detect the mimicked protein, and antibodies to different peptides may be used for tracking the fate of various regions of a protein precursor which undergoes post-translational processing. The peptides and anti-peptide antibodies may be used in a variety of qualitative or quantitative assays for the mimicked protein, for instance in competition assays since it has been shown that even short peptides (e.g., about 9 amino acids) can bind and displace the larger peptides in immunoprecipitation assays. See, e.g., Wilson, et al., (1984) Cell 37:767–778. The anti-peptide antibodies of the invention also are useful for purification of the mimicked protein, for instance, by adsorption chromatography using methods known in the art.

Antigenic epitope-bearing peptides and polypeptides of the invention designed according to the above guidelines preferably contain a sequence of at least seven, more preferably at least nine and most preferably between about 10 to about 50 amino acids (i.e. any integer between 7 and 50) contained within the amino acid sequence of a polypeptide of the invention. However, peptides or polypeptides comprising a larger portion of an amino acid sequence of a polypeptide of the invention, containing about 50 to about 100 amino acids, or any length up to and including the entire amino acid sequence of a polypeptide of the invention, also are considered epitope-bearing peptides or polypeptides of the invention and also are useful for inducing antibodies that react with the mimicked protein. Preferably, the amino acid sequence of the epitope-bearing peptide is selected to provide substantial solubility in aqueous solvents (i.e., the sequence includes relatively hydrophilic residues and highly hydrophobic sequences are preferably avoided); and sequences containing proline residues are particularly preferred.

Non-limiting examples of antigenic polypeptides or peptides that can be used to generate an enterococcal-specific immune response or antibodies include portions of the amino acid sequences identified in Table 1. More specifically, Table 4 discloses a list of non-limiting residues that are involved in the antigenicity of the epitope-bearing fragments of the present invention. Therefore, the present inventions provides for isolatd and purified antigenic epitope-bearing fragements of the polypeptides of the present invention comprising a peptide sequences of Table 4. The antigenic epitope-bearing fragments comprising a peptide sequence of Table 4 preferably contain a sequence of at least seven, more preferably at least nine and most preferably between about 10 to about 50 amino acids (i.e. any integer between 7 and 50) of a polypeptide of the present invention. That is, included in the present invention are antigenic polypeptides between the integers of 7 and 50 amino acid in length comprising one or more of the sequences of Table 4. Therefore, in most cases, the polypeptides of Table 4 make up only a portion of the antigenic polypeptide. All combinations of sequences between the integers of 7 and 50 amino acid in length comprising one or more of the sequences of Table 4 are included. The antigenic epitope-bearing fragements may be specified by either the number of contiguous amino acid residues or by specific N-terminal and C-terminal positions as described above for the polypeptide fragements of the present invention, wherein the initiation codon is residue 1. Any number of the described antigenic epitope-bearing fragements of the present invention may also be excluded from the present invention in the same manner.

The epitope-bearing peptides and polypeptides of the invention may be produced by any conventional means for making peptides or polypeptides including recombinant means using nucleic acid molecules of the invention. For instance, an epitope-bearing amino acid sequence of the present invention may be fused to a larger polypeptide which acts as a carrier during recombinant production and purification, as well as during immunization to produce anti-peptide antibodies. Epitope-bearing peptides also may be synthesized using known methods of chemical synthesis. For instance, Houghten has described a simple method for synthesis of large numbers of peptides, such as 10–20 mg of 248 different 13 residue peptides representing single amino acid variants of a segment of the HA1 polypeptide which were prepared and characterized (by ELISA-type binding studies) in less than four weeks (Houghten, R. A. Proc. Natl. Acad. Sci. USA 82:5131–5135 (1985)). This "Simultaneous Multiple Peptide Synthesis (SMPS)" process is further described in U.S. Pat. No. 4,631,211 to Houghten and coworkers (1986). In this procedure the individual resins for the solid-phase synthesis of various peptides are contained in separate solvent-permeable packets, enabling the optimal use of the many identical repetitive steps involved in solid-phase methods. A completely manual procedure allows 500–1000 or more syntheses to be conducted simultaneously (Houghten et al. (1985) Proc. Natl. Acad. Sci. 82:5131–5135 at 5134.

Epitope-bearing peptides and polypeptides of the invention are used to induce antibodies according to methods well known in the art. See, e.g., Sutcliffe, et al., supra;; Wilson, et al., supra;; and Bittle, et al. (1985) J. Gen. Virol. 66:2347–2354. Generally, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine may be coupled to carrier using a linker such as m-maleimidobenzoyl-N-hydroxysuccinimide ester (MBS), while other peptides may be coupled to carrier using a more general linking agent such as glutaraldehyde. Animals such as rabbits, rats and mice are immunized with either free or carrier-coupled peptides, for instance, by intraperitoneal and/or intradermal injection of emulsions containing about 100 $\mu$g peptide or carrier protein and Freund's adjuvant. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

Immunogenic epitope-bearing peptides of the invention, i.e., those parts of a protein that elicit an antibody response when the whole protein is the immunogen, are identified according to methods known in the art. For instance, Geysen, et aL, supra, discloses a procedure for rapid concurrent synthesis on solid supports of hundreds of peptides of sufficient purity to react in an ELISA. Interaction of synthesized peptides with antibodies is then easily detected without removing them from the support. In this manner a peptide bearing an immunogenic epitope of a desired protein may be identified routinely by one of ordinary skill in the art. For instance, the immunologically important epitope in the coat protein of foot-and-mouth disease virus was located by Geysen et al. supra with a resolution of seven amino acids by synthesis of an overlapping set of all 208 possible hexapeptides covering the entire 213 amino acid sequence of the protein. Then, a complete replacement set of peptides in which all 20 amino acids were substituted in turn at every position within the epitope were synthesized, and the particular amino acids conferring specificity for the reaction with antibody were determined. Thus, peptide analogs of the epitope-bearing peptides of the invention can be made routinely by this method. U.S. Pat. No. 4,708,781 to Geysen (1987) further describes this method of identifying a peptide bearing an immunogenic epitope of a desired protein.

Further still, U.S. Pat. No. 5,194,392, to Geysen (1990), describes a general method of detecting or determining the sequence of monomers (amino acids or other compounds) which is a topological equivalent of the epitope (i.e., a "mimotope") which is complementary to a particular paratope (antigen binding site) of an antibody of interest. More generally, U.S. Pat. No. 4,433,092, also to Geysen (1989), describes a method of detecting or determining a sequence of monomers which is a topographical equivalent of a ligand which is complementary to the ligand binding site of a particular receptor of interest. Similarly, U.S. Pat. No. 5,480,971 to Houghten, R. A. et al. (1996) discloses linear $C_1$–$C_7$-alkyl peralkylated oligopeptides and sets and libraries of such peptides, as well as methods for using such oligopeptide sets and libraries for determining the sequence of a peralkylated oligopeptide that preferentially binds to an acceptor molecule of interest. Thus, non-peptide analogs of the epitope-bearing peptides of the invention also can be made routinely by these methods. The entire disclosure of each document cited in this section on "Polypeptides and Fragments" is hereby incorporated herein by reference.

As one of skill in the art will appreciate, the polypeptides of the present invention and the epitope-bearing fragments thereof described above can be combined with parts of the constant domain of immunoglobulins (IgG), resulting in chimeric polypeptides. These fusion proteins facilitate purification and show an increased half-life in vivo. This has been shown, e.g., for chimeric proteins consisting of the first two domains of the human CD4-polypeptide and various domains of the constant regions of the heavy or light chains of mammalian immunoglobulins. (EPA 0,394,827; Traunecker et al. (1988) Nature 331:84–86. Fusion proteins that have a disulfide-linked dimeric structure due to the IgG part can also be more efficient in binding and neutralizing other molecules than a monomeric *E. faecalis* polypeptide or fragment thereof alone. See Fountoulakis et al. (1995) J. Biochem. 270:3958–3964. Nucleic acids encoding the above epitopes of *E. faecalis* polypeptides can also be recombined with a gene of interest as an epitope tag to aid in detection and purification of the expressed polypeptide.

Antibodies

*E. faecalis* protein-specific antibodies for use in the present invention can be raised against the intact *E. faecalis* protein or an antigenic polypeptide fragment thereof, which may be presented together with a carrier protein, such as an albumin, to an animal system (such as rabbit or mouse) or, if it is long enough (at least about 25 amino acids), without a carrier.

As used herein, the term "antibody" (Ab) or "monoclonal antibody" (Mab) is meant to include intact molecules, single chain whole antibodies, and antibody fragments. Antibody fragments of the present invention include Fab and F(ab')2 and other fragments including single-chain Fvs (scFv) and disulfide-linked Fvs (sdFv). Also included in the present invention are chimeric and humanized monoclonal antibodies and polyclonal antibodies specific for the polypeptides of the present invention. The antibodies of the present invention may be prepared by any of a variety of methods. For example, cells expressing a polypeptide of the present invention or an antigenic fragment thereof can be administered to an animal in order to induce the production of sera containing polyclonal antibodies. For example, a preparation of E. faecalis polypeptide or fragment thereof is prepared and purified to render it substantially free of natural contaminants. Such a preparation is then introduced into an animal in order to produce polyclonal antisera of greater specific activity.

In a preferred method, the antibodies of the present invention are monoclonal antibodies or binding fragments thereof. Such monoclonal antibodies can be prepared using hybridoma technology. See, e.g., Harlow et al., ANTIBODIES: A LABORATORY MANUAL, (Cold Spring Harbor Laboratory Press, 2nd ed. 1988); Hammerling, et al., in: MONOCLONAL ANTIBODIES AND T-CELL HYBRIDOMAS 563–681 (Elsevier, N.Y., 1981). Fab and F(ab')2 fragments may be produced by proteolytic cleavage, using enzymes such as papain (to produce Fab fragments) or pepsin (to produce F(ab')2 fragments). Alternatively, E. faecalis polypeptide-binding fragments, chimeric, and humanized antibodies can be produced through the application of recombinant DNA technology or through synthetic chemistry using methods known in the art.

Alternatively, additional antibodies capable of binding to the polypeptide antigen of the present invention may be produced in a two-step procedure through the use of anti-idiotypic antibodies. Such a method makes use of the fact that antibodies are themselves antigens, and that, therefore, it is possible to obtain an antibody which binds to a second antibody. In accordance with this method, E. faecalis polypeptide-specific antibodies are used to immunize an animal, preferably a mouse. The splenocytes of such an animal are then used to produce hybridoma cells, and the hybridoma cells are screened to identify clones which produce an antibody whose ability to bind to the E. faecalis polypeptide-specific antibody can be blocked by the E. faecalis polypeptide antigen. Such antibodies comprise anti-idiotypic antibodies to the E. faecalis polypeptide-specific antibody and can be used to immunize an animal to induce formation of further E. faecalis polypeptide-specific antibodies.

Antibodies and fragements thereof of the present invention may be described by the portion of a polypeptide of the present invention recognized or specifically bound by the antibody. Antibody binding fragements of a polypeptide of the present invention may be described or specified in the same manner as for polypeptide fragments discussed above., i.e, by N-terminal and C-terminal positions or by size in contiguous amino acid residues. Any number of antibody binding fragments, of a polypeptide of the present invention, specified by N-terminal and C-terminal positions or by size in amino acid residues, as described above, may also be excluded from the present invention. Therefore, the present invention includes antibodies the specifically bind a particuarlly discribed fragement of a polypeptide of the present invention and allows for the exclusion of the same.

Antibodies and fragements thereof of the present invention may also be described or specified in terms of their cross-reactivity. Antibodies and fragements that do not bind polypeptides of any other species of Enterococcus other than E. faecalis are included in the present invention. Likewise, antibodies and fragements that bind only species of Enterococcus, i.e. antibodies and fragements that do not bind bacteria from any genus other than Enterococcus, are included in the present invention.

Diagnostic Assays

The present invention further relates to methods for assaying enterococcal infection in an animal by detecting the expression of genes encoding staphylococcal polypeptides of the present invention. The methods comprise analyzing tissue or body fluid from the animal for Enterococcus-specific antibodies, nucleic acids, or proteins. Analysis of nucleic acid specific to Enterococcus is assayed by PCR or hybridization techniques using nucleic acid sequences of the present invention as either hybridization probes or primers. See, e.g., Sambrook et al. Molecular cloning: A Laboratory Manual (Cold Spring Harbor Laboratory Press, 2nd ed., 1989, page 54 reference); Eremeeva et al. (1994) J. Clin. Microbiol. 32:803–810 (describing differentiation among spotted fever group Rickettsiae species by analysis of restriction fragment length polymorphism of PCR-amplified DNA) and Chen et al. 1994 J. Clin. Microbiol. 32:589–595 (detecting B. burgdorferi nucleic acids via PCR).

Where diagnosis of a disease state related to infection with Enterococcus has already been made, the present invention is useful for monitoring progression or regression of the disease state whereby patients exhibiting enhanced Enterococcus gene expression will experience a worse clinical outcome relative to patients expressing these gene(s) at a lower level.

By "biological sample" is intended any biological sample obtained from an animal, cell line, tissue culture, or other source which contains Enterococcus polypeptide, mRNA, or DNA. Biological samples include body fluids (such as saliva, blood, plasma, urine, mucus, synovial fluid, etc.) tissues (such as muscle, skin, and cartilage) and any other biological source suspected of containing Enterococcus polypeptides or nucleic acids. Methods for obtaining biological samples such as tissue are well known in the art.

The present invention is useful for detecting diseases related to Enterococcus infections in animals. Preferred animals include monkeys, apes, cats, dogs, birds, cows, pigs, mice, horses, rabbits and humans. Particularly preferred are humans.

Total RNA can be isolated from a biological sample using any suitable technique such as the single-step guanidinium-thiocyanate-phenol-chloroform method described in Chomczynski et al. (1987) Anal. Biochem. 162:156–159. mRNA encoding Enterococcus polypeptides having sufficient homology to the nucleic acid sequences identified in Table 1 to allow for hybridization between complementary sequences are then assayed using any appropriate method. These include Northern blot analysis, S1 nuclease mapping, the polymerase chain reaction (PCR), reverse transcription in combination with the polymerase chain reaction (RT-PCR), and reverse transcription in combination with the ligase chain reaction (RT-LCR).

Northern blot analysis can be performed as described in Harada et al. (1990) Cell 63:303–312. Briefly, total RNA is prepared from a biological sample as described above. For the Northern blot, the RNA is denatured in an appropriate buffer (such as glyoxal/dimethyl sulfoxide/sodium phosphate buffer), subjected to agarose gel electrophoresis, and transferred onto a nitrocellulose filter. After the RNAs have been linked to the filter by a UV linker, the filter is prehybridized in a solution containing formamide, SSC, Denhardt's solution, denatured salmon sperm, SDS, and sodium phosphate buffer. A *E. faecalis* polynucleotide sequence shown in Table 1 labeled according to any appropriate method (such as the $^{32}$P-multiprimed DNA labeling system (Amersham)) is used as probe. After hybridization overnight, the filter is washed and exposed to x-ray film. DNA for use as probe according to the present invention is described in the sections above and will preferably at least 15 nucleotides in length.

S1 mapping can be performed as described in Fujita et al. (1987) Cell 49:357–367. To prepare probe DNA for use in S1 mapping, the sense strand of an above-described *E. faecalis* DNA sequence of the present invention is used as a template to synthesize labeled antisense DNA. The antisense DNA can then be digested using an appropriate restriction endonuclease to generate further DNA probes of a desired length. Such antisense probes are useful for visualizing protected bands corresponding to the target mRNA (i.e., mRNA encoding Enterococcus polypeptides).

Levels of mRNA encoding Enterococcus polypeptides are assayed, for e.g., using the RT-PCR method described in Makino et al. (1990) Technique 2:295–301. By this method, the radioactivities of the "amplicons" in the polyacrylamide gel bands are linearly related to the initial concentration of the target mRNA. Briefly, this method involves adding total RNA isolated from a biological sample in a reaction mixture containing a RT primer and appropriate buffer. After incubating for primer annealing, the mixture can be supplemented with a RT buffer, dNTPs, DTT, RNase inhibitor and reverse transcriptase. After incubation to achieve reverse transcription of the RNA, the RT products are then subject to PCR using labeled primers. Alternatively, rather than labeling the primers, a labeled dNTP can be included in the PCR reaction mixture. PCR amplification can be performed in a DNA thermal cycler according to conventional techniques. After a suitable number of rounds to achieve amplification, the PCR reaction mixture is electrophoresed on a polyacrylamide gel. After drying the gel, the radioactivity of the appropriate bands (corresponding to the mRNA encoding the Enterococcus polypeptides of the present invention) are quantified using an imaging analyzer. RT and PCR reaction ingredients and conditions, reagent and gel concentrations, and labeling methods are well known in the art. Variations on the RT-PCR method will be apparent to the skilled artisan. Other PCR methods that can detect the nucleic acid of the present invention can be found in PCR PRIMER: A LABORATORY MANUAL (C. W. Dieffenbach et al. eds., Cold Spring Harbor Lab Press, 1995).

The polynucleotides of the present invention, including both DNA and RNA, may be used to detect polynucleotides of the present invention or Enterococcal species including *E. faecalis* using bio chip technology. The present invention includes both high density chip arrays (>1000 oligonucleotides per cm$^2$) and low density chip arrays (<1000 oligonucleotides per cm$^2$). Bio chips comprising arrays of polynucleotides of the present invention may be used to detect Enterococcal species, including *E. faecalis,* in biological and environmental samples and to diagnose an animal, including humans, with an *E. faecalis* or other Enterococcal infection. The bio chips of the present invention may comprise polynucleotide sequences of other pathogens including bacteria, viral, parasitic, and fungal polynucleotide sequences, in addition to the polynucleotide sequences of the present invention, for use in rapid diffenertial pathogenic detection and diagnosis. The bio chips can also be used to monitor an *E. faecalis* or other Enterococcal infections and to monitor the genetic changes (deletions, insertions, mismatches, etc.) in response to drug therapy in the clinic and drug development in the laboratory. The bio chip technology comprising arrays of polynucleotides of the present invention may also be used to simultaneously monitor the expression of a multiplicity of genes, including those of the present invention. The polynucleotides used to comprise a selected array may be specified in the same manner as for the fragements, i.e, by their 5' and 3' positions or length in contigious base pairs and include from. Methods and particular uses of the polynucleotides of the present invention to detect Enterococcal species, including *E. faecalis,* using bio chip technology include those known in the art and those of: U.S. Pat. Nos. 5,510,270, 5,545,531, 5,445,934, 5,677,195, 5,532, 128, 5,556,752, 5,527,681, 5,451,683, 5,424,186, 5,607,646, 5,658,732 and World Patent Nos. WO/9710365, WO/9511995, WO/9743447, WO/9535505, each incorporated herein in their entireties.

Biosensors using the polynucleotides of the present invention may also be used to detect, diagnose, and monitor *E. faecalis* or other Enterococcal species and infections thereof. Biosensors using the polynucleotides of the present invention may also be used to detect particular polynucleotides of the present invention. Biosensors using the polynucleotides of the present invention may also be used to monitor the genetic changes (deletions, insertions, mismatches, etc.) in response to drug therapy in the clinic and drug development in the laboratory. Methods and particular uses of the polynucleotides of the present invention to detect Enterococcal species, including *E. faecalis,* using biosenors include those known in the art and those of: U.S. Pat. Nos. 5,721,102, 5,658,732, 5,631,170, and World Patent Nos. WO97/35011, WO/9720203, each incorporated herein in their entireties.

Thus, the present invention includes both bio chips and biosensors comprising polynucleotides of the present invention and methods of their use.

Assaying Enterococcus polypeptide levels in a biological sample can occur using any art-known method, such as antibody-based techniques. For example, Enterococcus polypeptide expression in tissues can be studied with classical immunohistological methods. In these, the specific recognition is provided by the primary antibody (polyclonal or monoclonal) but the secondary detection system can utilize fluorescent, enzyme, or other conjugated secondary antibodies. As a result, an immunohistological staining of tissue section for pathological examination is obtained. Tissues can also be extracted, e.g., with urea and neutral detergent, for the liberation of Enterococcus polypeptides for Western-blot or dot/slot assay. See, e.g., Jalkanen, M. et al. (1985) J. Cell. Biol. 101:976–985; Jalkanen, M. et al. (1987) J. Cell. Biol. 105:3087–3096. In this technique, which is based on the use of cationic solid phases, quantitation of a Enterococcus polypeptide can be accomplished using an isolated Enterococcus polypeptide as a standard. This technique can also be applied to body fluids.

Other antibody-based methods useful for detecting Enterococcus polypeptide gene expression include immunoassays, such as the ELISA and the radioimmunoassay (RIA). For example, a Enterococcus polypeptide-specific monoclonal antibodies can be used both as an immunoabsorbent and as an enzyme-labeled probe to detect and quantify a Enterococcus polypeptide. The amount of a Enterococcus polypeptide present in the sample can be calculated by reference to the amount present in a standard preparation using a linear regression computer algorithm. Such an ELISA is described in Iacobelli et al. (1988) Breast Cancer Research and Treatment 11:19–30. In another ELISA assay, two distinct specific monoclonal antibodies can be used to to detect Enterococcus polypeptides in a body fluid. In this assay, one of the antibodies is used as the immunoabsorbent and the other as the enzyme-labeled probe.

The above techniques may be conducted essentially as a "one-step" or "two-step" assay. The "one-step" assay involves contacting the Enterococcus polypeptide with immobilized antibody and, without washing, contacting the mixture with the labeled antibody. The "two-step" assay involves washing before contacting the mixture with the labeled antibody. Other conventional methods may also be employed as suitable. It is usually desirable to immobilize one component of the assay system on a support, thereby allowing other components of the system to be brought into contact with the component and readily removed from the sample. Variations of the above and other immunological methods included in the present invention can also be found in Harlow et al., ANTIBODIES: A LABORATORY MANUAL, (Cold Spring Harbor Laboratory Press, 2nd ed. 1988).

Suitable enzyme labels include, for example, those from the oxidase group, which catalyze the production of hydrogen peroxide by reacting with substrate. Glucose oxidase is particularly preferred as it has good stability and its substrate (glucose) is readily available. Activity of an oxidase label may be assayed by measuring the concentration of hydrogen peroxide formed by the enzyme-labeled antibody/substrate reaction. Besides enzymes, other suitable labels include radioisotopes, such as iodine ($^{125}I$, $^{121}I$), carbon ($^{14}C$), sulphur ($^{35}S$), tritium ($^{3}H$), indium ($^{112}In$), and technetium ($^{99m}Tc$), and fluorescent labels, such as fluorescein and rhodamine, and biotin.

Further suitable labels for the Enterococcus polypeptide-specific antibodies of the present invention are provided below. Examples of suitable enzyme labels include malate dehydrogenase, Enterococcal nuclease, delta-5-steroid isomerase, yeast-alcohol dehydrogenase, alpha-glycerol phosphate dehydrogenase, triose phosphate isomerase, peroxidase, alkaline phosphatase, asparaginase, glucose oxidase, beta-galactosidase, ribonuclease, urease, catalase, glucose-6-phosphate dehydrogenase, glucoamylase, and acetylcholine esterase.

Examples of suitable radioisotopic labels include $^{3}H$, $^{111}In$, $^{125}I$, $^{131}I$, $^{32}P$, $^{35}S$, $^{14}C$, $^{51}Cr$, $^{57}To$, $^{58}Co$, $^{59}Fe$, $^{75}Se$, $^{152}Eu$, $^{90}Y$, $^{67}Cu$, $^{217}Ci$, $^{211}At$, $^{212}Pb$, $^{47}Sc$, $^{109}Pd$, etc. $^{111}In$ is a preferred isotope where in vivo imaging is used since its avoids the problem of dehalogenation of the $^{125}I$ or $^{131}I$-labeled monoclonal antibody by the liver. In addition, this radionucleotide has a more favorable gamma emission energy for imaging. See, e.g., Perkins et al. (1985) Eur. J. Nucl. Med. 10:296–301; Carasquillo et al. (1987) J. Nucl. Med. 28:281–287. For example, $^{111}In$ coupled to monoclonal antibodies with 1-(P-isothiocyanatobenzyl)-DPTA has shown little uptake in non-tumors tissues, particularly the liver, and therefore enhances specificity of tumor localization. See, Esteban et al. (1987) J. Nucl. Med. 28:861–870.

Examples of suitable non-radioactive isotopic labels include $^{157}Gd$, $^{55}Mn$, $^{162}Dy$, $^{52}Tr$, and $^{56}Fe$.

Examples of suitable fluorescent labels include an $^{152}Eu$ label, a fluorescein label, an isothiocyanate label, a rhodamine label, a phycoerythrin label, a phycocyanin label, an allophycocyanin label, an o-phthaldehyde label, and a fluorescamine label.

Examples of suitable toxin labels include, Pseudomonas toxin, diphtheria toxin, ricin, and cholera toxin.

Examples of chemiluminescent labels include a luminal label, an isoluminal label, an aromatic acridinium ester label, an imidazole label, an acridinium salt label, an oxalate ester label, a luciferin label, a luciferase label, and an aequorin label.

Examples of nuclear magnetic resonance contrasting agents include heavy metal nuclei such as Gd, Mn, and iron.

Typical techniques for binding the above-described labels to antibodies are provided by Kennedy et al. (1976) Clin. Chim. Acta 70:1–31, and Schurs et al. (1977) Clin. Chim. Acta 81:1–40. Coupling techniques mentioned in the latter are the glutaraldehyde method, the periodate method, the dimaleimide method, the m-maleimidobenzyl-N-hydroxy-succinimide ester method, all of which methods are incorporated by reference herein.

In a related aspect, the invention includes a diagnostic kit for use in screening serum containing antibodies specific against E. faecalis infection. Such a kit may include an isolated E. faecalis antigen comprising an epitope which is specifically immunoreactive with at least one anti-E. faecalis antibody. Such a kit also includes means for detecting the binding of said antibody to the antigen. In specific embodiments, the kit may include a recombinantly produced or chemically synthesized peptide or polypeptide antigen. The peptide or polypeptide antigen may be attached to a solid support.

In a more specific embodiment, the detecting means of the above-described kit includes a solid support to which said peptide or polypeptide antigen is attached. Such a kit may also include a non-attached reporter-labeled anti-human antibody. In this embodiment, binding of the antibody to the E. faecalis antigen can be detected by binding of the reporter labeled antibody to the anti-E. faecalis polypeptide antibody.

In a related aspect, the invention includes a method of detecting E. faecalis infection in a subject. This detection method includes reacting a body fluid, preferably serum, from the subject with an isolated E. faecalis antigen, and examining the antigen for the presence of bound antibody. In a specific embodiment, the method includes a polypeptide antigen attached to a solid support, and serum is reacted with the support. Subsequently, the support is reacted with a reporter-labeled anti-human antibody. The support is then examined for the presence of reporter-labeled antibody.

The solid surface reagent employed in the above assays and kits is prepared by known techniques for attaching protein material to solid support material, such as polymeric beads, dip sticks, 96-well plates or filter material. These attachment methods generally include non-specific adsorption of the protein to the support or covalent attachment of the protein , typically through a free amine group, to a chemically reactive group on the solid support, such as an activated carboxyl, hydroxyl, or aldehyde group. Alternatively, streptavidin coated plates can be used in conjunction with biotinylated antigen(s).

The polypeptides and antibodies of the present invention, including fragments thereof, may be used to detect Enterococcal species including E. faecalis using bio chip and biosensor technology. Bio chip and biosensors of the present invention may comprise the polypeptides of the present invention to detect antibodies, which specifically recognize Enterococcal species, including E. faecalis. Bio chip and biosensors of the present invention may also comprise antibodies which specifically recognize the polypeptides of the present invention to detect Enterococcal species, including E. faecalis or specific polypeptides of the present invention. Bio chips or biosensors comprising polypeptides or antibodies of the present invention may be used to detect Enterococcal species, including *E. faecalis,* in biological and environmental samples and to diagnose an animal, including humans, with an *E. faecalis* or other Enterococcal infection. Thus, the present invention includes both bio chips and biosensors comprising polypeptides or antibodies of the present invention and methods of their use.

The bio chips of the present invention may further comprise polypeptide sequences of other pathogens including bacteria, viral, parasitic, and fungal polypeptide sequences, in addition to the polypeptide sequences of the present invention, for use in rapid diffenertial pathogenic detection and diagnosis. The bio chips of the present invention may further comprise antibodies or fragements thereof specific for other pathogens including bacteria, viral, parasitic, and fungal polypeptide sequences, in addition to the antibodies or fragements thereof of the present invention, for use in rapid diffenertial pathogenic detection and diagnosis. The bio chips and biosensors of the present invention may also be used to monitor an *E. faecalis* or other Enterococcal infection and to monitor the genetic changes (amio acid deletions, insertions, substitutions, etc.) in response to drug therapy in the clinic and drug development in the laboratory. The bio chip and biosensors comprising polypeptides or antibodies of the present invention may also be used to simultaneously monitor the expression of a multiplicity of polypeptides, including those of the present invention. The polypeptides used to comprise a bio chip or biosensor of the present invention may be specified in the same manner as for the fragements, i.e, by their N-terminal and C-terminal positions or length in contigious amino acid residue. Methods and particular uses of the polypeptides and antibodies of the present invention to detect Enterococcal species, including *E. faecalis,* or specific polypeptides using bio chip and biosensor technology include those known in the art, those of the U.S. Patent Nos. and World Patent Nos. listed above for bio chips and biosensors using polynucleotides of the present invention, and those of: U.S. Pat. Nos. 5,658,732, 5,135,852, 5,567,301, 5,677,196, 5,690,894 and World Patent Nos. WO9729366, WO9612957, each incorporated herein in their entireties.

Treatment

Agonists and Antagonists—Assays and Molecules

The invention also provides a method of screening compounds to identify those which enhance or block the biological activity of the *E. faecalis* polypeptides of the present invention. The present invention further provides where the compounds kill or slow the growth of *E. faecalis.* The ability of *E. faecalis* antagonists, including *E. faecalis* ligands, to prophylactically or therapeutically block antibiotic resistance may be easily tested by the skilled artisan. See, e.g., Straden et al. (1997) J. Bacteriol. 179(1):9–16.

An agonist is a compound which increases the natural biological function or which functions in a manner similar to the polypeptides of the present invention, while antagonists decrease or eliminate such functions. Potential antagonists include small organic molecules, peptides, polypeptides, and antibodies that bind to a polypeptide of the invention and thereby inhibit or extinguish its activity.

The antagonists may be employed for instance to inhibit peptidoglycan cross bridge formation. Antibodies against *E. faecalis* may be employed to bind to and inhibit *E. faecalis* activity to treat antibiotic resistance. Any of the above antagonists may be employed in a composition with a pharmaceutically acceptable carrier.

Vaccines

The present invention also provides vaccines comprising one or more polypeptides of the present invention. Heterogeneity in the composition of a vaccine may be provided by combining *E. faecalis* polypeptides of the present invention. Multi-component vaccines of this type are desirable because they are likely to be more effective in eliciting protective immune responses against multiple species and strains of the Enterococcus genus than single polypeptide vaccines.

Multi-component vaccines are known in the art to elicit antibody production to numerous immunogenic components. See, e.g., Decker et al. (1996) J. Infect. Dis. 174:S270–275. In addition, a hepatitis B, diphtheria, tetanus, pertussis tetravalent vaccine has recently been demonstrated to elicit protective levels of antibodies in human infants against all four pathogenic agents. See, e.g., Aristegui, J. et al. (1997) Vaccine 15:7–9.

The present invention in addition to single-component vaccines includes multi-component vaccines. These vaccines comprise more than one polypeptide, immunogen or antigen. Thus, a multi-component vaccine would be a vaccine comprising more than one of the *E. faecalis* polypeptides of the present invention.

Further within the scope of the invention are whole cell and whole viral vaccines. Such vaccines may be produced recombinantly and involve the expression of one or more of the *E. faecalis* polypeptides described in Table 1. For example, the *E. faecalis* polypeptides of the present invention may be either secreted or localized intracellular, on the cell surface, or in the periplasmic space. Further, when a recombinant virus is used, the *E. faecalis* polypeptides of the present invention may, for example, be localized in the viral envelope, on the surface of the capsid, or internally within the capsid. Whole cells vaccines which employ cells expressing heterologous proteins are known in the art. See, e.g., Robinson, K. et al. (1997) Nature Biotech. 15:653–657; Sirard, J. et al. (1997) Infect. Immun. 65:2029–2033; Chabalgoity, J. et al. (1997) Infect. Immun. 65:2402–2412. These cells may be administered live or may be killed prior to administration. Chabalgoity, J. et al., supra, for example, report the successful use in mice of a live attenuated Salmonella vaccine strain which expresses a portion of a platyhelminth fatty acid-binding protein as a fusion protein on its cells surface.

A multi-component vaccine can also be prepared using techniques known in the art by combining one or more *E. faecalis* polypeptides of the present invention, or fragments thereof, with additional non-Enterococcal components (e.g., diphtheria toxin or tetanus toxin, and/or other compounds known to elicit an immune response). Such vaccines are useful for eliciting protective immune responses to both members of the Enterococcus genus and non-Enterococcal pathogenic agents.

The vaccines of the present invention also include DNA vaccines. DNA vaccines are currently being developed for a number of infectious diseases. See, et al., Boyer, et al. (1997) Nat. Med. 3:526–532; reviewed in Spier, R. (1996) Vaccine 14:1285–1288. Such DNA vaccines contain a nucleotide sequence encoding one or more *E. faecalis* polypeptides of the present invention oriented in a manner that allows for expression of the subject polypeptide. For example, the direct administration of plasmid DNA encoding *B. burgdorgeri* OspA has been shown to elicit protective immunity in mice against borrelial challenge. See, Luke et al. (1997) J. Infect. Dis. 175:91–97.

The present invention also relates to the administration of a vaccine which is co-administered with a molecule capable of modulating immune responses. Kim et al. (1997) Nature Biotech. 15:641–646, for example, report the enhancement of immune responses produced by DNA immunizations when DNA sequences encoding molecules which stimulate the immune response are co-administered. In a similar fashion, the vaccines of the present invention may be co-administered with either nucleic acids encoding immune modulators or the immune modulators themselves. These immune modulators include granulocyte macrophage colony stimulating factor (GM-CSF) and CD86.

The vaccines of the present invention may be used to confer resistance to Enterococcal infection by either passive or active immunization. When the vaccines of the present invention are used to confer resistance to Enterococcal infection through active immunization, a vaccine of the present invention is administered to an animal to elicit a protective immune response which either prevents or attenuates a Enterococcal infection. When the vaccines of the present invention are used to confer resistance to Enterococcal infection through passive immunization, the vaccine is provided to a host animal (e.g., human, dog, or mouse), and the antisera elicited by this antisera is recovered and directly provided to a recipient suspected of having an infection caused by a member of the Enterococcus genus.

The ability to label antibodies, or fragments of antibodies, with toxin molecules provides an additional method for treating Enterococcal infections when passive immunization is conducted. In this embodiment, antibodies, or fragments of antibodies, capable of recognizing the E. faecalis polypeptides disclosed herein, or fragments thereof, as well as other Enterococcus proteins, are labeled with toxin molecules prior to their administration to the patient. When such toxin derivatized antibodies bind to Enterococcus cells, toxin moieties will be localized to these cells and will cause their death.

The present invention thus concerns and provides a means for preventing or attenuating a Enterococcal infection resulting from organisms which have antigens that are recognized and bound by antisera produced in response to the polypeptides of the present invention. As used herein, a vaccine is said to prevent or attenuate a disease if its administration to an animal results either in the total or partial attenuation (i.e., suppression) of a symptom or condition of the disease, or in the total or partial immunity of the animal to the disease.

The administration of the vaccine (or the antisera which it elicits) may be for either a "prophylactic" or "therapeutic" purpose. When provided prophylactically, the compound(s) are provided in advance of any symptoms of Enterococcal infection. The prophylactic administration of the compound(s) serves to prevent or attenuate any subsequent infection. When provided therapeutically, the compound(s) is provided upon or after the detection of symptoms which indicate that an animal may be infected with a member of the Enterococcus genus. The therapeutic administration of the compound(s) serves to attenuate any actual infection. Thus, the E. faecalis polypeptides, and fragments thereof, of the present invention may be provided either prior to the onset of infection (so as to prevent or attenuate an anticipated infection) or after the initiation of an actual infection.

The polypeptides of the invention, whether encoding a portion of a native protein or a functional derivative thereof, may be administered in pure form or may be coupled to a macromolecular carrier. Example of such carriers are proteins and carbohydrates. Suitable proteins which may act as macromolecular carrier for enhancing the immunogenicity of the polypeptides of the present invention include keyhole limpet hemacyanin (KLH) tetanus toxoid, pertussis toxin, bovine serum albumin, and ovalbumin. Methods for coupling the polypeptides of the present invention to such macromolecular carriers are disclosed in Harlow et al., ANTIBODIES: A LABORATORY MANUAL, (Cold Spring Harbor Laboratory Press, 2nd ed. 1988).

A composition is said to be "pharmacologically or physiologically acceptable" if its administration can be tolerated by a recipient animal and is otherwise suitable for administration to that animal. Such an agent is said to be administered in a "therapeutically effective amount" if the amount administered is physiologically significant. An agent is physiologically significant if its presence results in a detectable change in the physiology of a recipient patient.

While in all instances the vaccine of the present invention is administered as a pharmacologically acceptable compound, one skilled in the art would recognize that the composition of a pharmacologically acceptable compound varies with the animal to which it is administered. For example, a vaccine intended for human use will generally not be co-administered with Freund's adjuvant. Further, the level of purity of the E. faecalis polypeptides of the present invention will normally be higher when administered to a human than when administered to a non-human animal.

As would be understood by one of ordinary skill in the art, when the vaccine of the present invention is provided to an animal, it may be in a composition which may contain salts, buffers, adjuvants, or other substances which are desirable for improving the efficacy of the composition. Adjuvants are substances that can be used to specifically augment a specific immune response. These substances generally perform two functions: (1) they protect the antigen(s) from being rapidly catabolized after administration and (2) they non-specifically stimulate immune responses.

Normally, the adjuvant and the composition are mixed prior to presentation to the immune system, or presented separately, but into the same site of the animal being immunized. Adjuvants can be loosely divided into several groups based upon their composition. These groups include oil adjuvants (for example, Freund's complete and incomplete), mineral salts (for example, $AlK(SO_4)_2$, $AlNa(SO_4)_2$, $AlNH_4(SO_4)$, silica, kaolin, and carbon), polynucleotides (for example, poly IC and poly AU acids), and certain natural substances (for example, wax D from *Mycobacterium tuberculosis*, as well as substances found in *Corynebacterium parvum*, or *Bordetella pertuss* is, and members of the genus Brucella. Other substances useful as adjuvants are the saponins such as, for example, Quil A. (Superfos A/S, Denmark). Preferred adjuvants for use in the present invention include aluminum salts, such as $AlK(SO_4)_2$, $AlNa(SO_4)_2$, and $AlNH_4(SO_4)$. Examples of materials suitable for use in vaccine compositions are provided in REMINGTON'S PHARMACEUTICAL SCIENCES 1324–1341 (A. Osol, ed, Mack Publishing Co, Easton, Pa., (1980) (incorporated herein by reference).

The therapeutic compositions of the present invention can be administered parenterally by injection, rapid infusion, nasopharyngeal absorption intranasopharangeally), dermoabsorption, or orally. The compositions may alternatively be administered intramuscularly, or intravenously. Compositions for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Carriers or occlusive dressings can be used to increase skin permeability and enhance antigen absorption. Liquid dosage forms for oral administration may generally comprise a liposome solution containing the liquid dosage form. Suitable forms for suspending liposomes include emulsions, suspensions, solutions, syrups, and elixirs containing inert diluents commonly used in the art, such as purified water. Besides the inert diluents, such compositions can also include adjuvants, wetting agents, emulsifying and suspending agents, or sweetening, flavoring, or perfuming agents.

Therapeutic compositions of the present invention can also be administered in encapsulated form. For example, intranasal immunization using vaccines encapsulated in biodegradable microsphere composed of poly(DL-lactide-co-glycolide). See, Shahin, R. et al. (1995) Infect. Immun. 63:1195–1200. Similarly, orally administered encapsulated *Salmonella typhimurium* antigens can also be used. Allaoui-Attarki, K. et al. (1997) Infect. Immun. 65:853–857. Encapsulated vaccines of the present invention can be administered by a variety of routes including those involving contacting the vaccine with mucous membranes (e.g., intranasally, intracolonicly, intraduodenally).

Many different techniques exist for the timing of the immunizations when a multiple administration regimen is utilized. It is possible to use the compositions of the invention more than once to increase the levels and diversities of expression of the immunoglobulin repertoire expressed by the immunized animal. Typically, if multiple immunizations are given, they will be given one to two months apart.

According to the present invention, an "effective amount" of a therapeutic composition is one which is sufficient to achieve a desired biological effect. Generally, the dosage needed to provide an effective amount of the composition will vary depending upon such factors as the animal's or human's age, condition, sex, and extent of disease, if any, and other variables which can be adjusted by one of ordinary skill in the art.

The antigenic preparations of the invention can be administered by either single or multiple dosages of an effective amount. Effective amounts of the compositions of the invention can vary from 0.01–1,000 µg/ml per dose, more preferably 0. 1–500 µg/ml per dose, and most preferably 10–300 µg/ml per dose.

Examples

Example 1
Isolation of a Selected DNA Clone from the Deposited Sample of *E. faecalis*

Three approaches can be used to isolate a *E. faecalis* clone comprising a polynucleotide of the present invention from any *E. faecalis* genomic DNA library. The *E. faecalis* strain V586 has been deposited as a convienent source for obtaining a *E. faecalis* strain although a wide varity of strains *E. faecalis* strains can be used which are known in the art.

*E. faecalis* genomic DNA is prepared using the following method. A 20 ml overnight bacterial culture grown in a rich medium (e.g., Trypticase Soy Broth, Brain Heart Infusion broth or Super broth), pelleted, washed two times with TES (30 mM Tris-pH 8.0, 25 mM EDTA, 50 mM NaCl), and resuspended in 5 ml high salt TES (2.5M NaCl). Lysostaphin is added to final concentration of approx 50 µg/ml and the mixture is rotated slowly 1 hour at 37 C. to make protoplast cells. The solution is then placed in incubator (or place in a shaking water bath) and warmed to 55 C. Five hundred micro liter of 20% sarcosyl in TES (final concentration 2%) is then added to lyse the cells. Next, guanidine HCl is added to a final concentration of 7M (3.69 g in 5.5 ml). The mixture is swirled slowly at 55 C. for 60–90 min (solution should clear). A CsCl gradient is then set up in SW41 ultra clear tubes using 2.0 ml 5.7M CsCl and overlaying with 2.85M CsCl. The gradient is carefully overlayed with the DNA-containing GuHCl solution. The gradient is spun at 30,000 rpm, 20 C. for 24 hr and the lower DNA band is collected. The volume is increased to 5 ml with TE buffer. The DNA is then treated with protease K (10 µg/ml) overnight at 37 C., and precipitated with ethanol. The precipitated DNA is resuspended in a desired buffer.

In the first method, a plasmid is directly isolated by screening a plasmid *E. faecalis* genomic DNA library using a polynucleotide probe corresponding to a polynucleotide of the present invention. Particularly, a specific polynucleotide with 30–40 nucleotides is synthesized using an Applied Biosystems DNA synthesizer according to the sequence reported. The oligonucleotide is labeled, for instance, with $^{32}$P-γ-ATP using T4 polynucleotide kinase and purified according to routine methods. (See, e.g., Maniatis et al., Molecular Cloning: A Laboratory Manual, Cold Spring Harbor Press, Cold Spring, N.Y. (1982).) The library is transformed into a suitable host, as indicated above (such as XL-1 Blue (Stratagene)) using techniques known to those of skill in the art. See, e.g., Sambrook et al. MOLECULAR CLONING: A LABORATORY MANUAL (Cold Spring Harbor, N.Y. 2nd ed. 1989); Ausubel et al., CURRENT PROTOCALS IN MOLECULAR BIOLOGY (John Wiley and Sons, N.Y. 1989). The transformants are plated on 1.5% agar plates (containing the appropriate selection agent, e.g., ampicillin) to a density of about 150 transformants (colonies) per plate. These plates are screened using Nylon membranes according to routine methods for bacterial colony screening. See, e.g., Sambrook et al. MOLECULAR CLONING: A LABORATORY MANUAL (Cold Spring Harbor, N.Y. 2nd ed. 1989); Ausubel et al., CURRENT PROTOCALS IN MOLECULAR BIOLOGY (John Wiley and Sons, N.Y. 1989) or other techniques known to those of skill in the art.

Alternatively, two primers of 15–25 nucleotides derived from the 5' and 3' ends of a polynucleotide of Table 1 are synthesized and used to amplify the desired DNA by PCR using a *E. faecalis* genomic DNA prep as a template. PCR is carried out under routine conditions, for instance, in 25 µl of reaction mixture with 0.5 ug of the above DNA template. A convenient reaction mixture is 1.5–5 mM $MgCl_2$, 0.01% (w/v) gelatin, 20 µM each of dATP, dCTP, dGTP, dTTP, 25 pmol of each primer and 0.25 Unit of Taq polymerase. Thirty five cycles of PCR (denaturation at 94° C. for 1 min; annealing at 55° C. for 1 min; elongation at 72° C. for 1 min) are performed with a Perkin-Elmer Cetus automated thermal cycler. The amplified product is analyzed by agarose gel electrophoresis and the DNA band with expected molecular weight is excised and purified. The PCR product is verified to be the selected sequence by subcloning and sequencing the DNA product.

Finally, overlapping oligos of the DNA sequences of Table 1 can be chemically synthesized and used to generate a nucleotide sequence of desired length using PCR methods known in the art.

Example 2(a)
Expression and Purification Enterococcal Polypeptides in *E. coli*

The bacterial expression vector pQE60 was used for bacterial expression of some of the polypeptide fragements used in the soft tissue and systemic infection models discussed below. (QIAGEN, Inc., 9259 Eton Avenue, Chatsworth, Calif., 91311). pQE60 encodes ampicillin antibiotic resistance ("Ampr") and contains a bacterial origin of replication ("ori"), an IPTG inducible promoter, a ribosome binding site ("RBS"), six codons encoding histidine residues that allow affinity purification using nickel-nitrilo-tri-acetic acid ("Ni-NTA") affinity resin (QIAGEN, Inc., supra) and suitable single restriction enzyme cleavage sites. These elements are arranged such that an inserted DNA fragment encoding a polypeptide expresses that polypeptide with the six His residues (i.e., a "6×His tag") covalently linked to the carboxyl terminus of that polypeptide.

The DNA sequence encoding the desired portion of a *E. faecalis* protein of the present invention was amplified from *E. faecalis* genomic DNA using PCR oligonucleotide primers which anneal to the 5' and 3' sequences coding for the portions of the *E. faecalis* polynucleotide shown in Table 1. Additional nucleotides containing restriction sites to facilitate cloning in the pQE60 vector are added to the 5' and 3' sequences, respectively.

For cloning the mature protein, the 5' primer has a sequence containing an appropriate restriction site followed by nucleotides of the amino terminal coding sequence of the desired *E. faecalis* polynucleotide sequence in Table 1. One of ordinary skill in the art would appreciate that the point in the protein coding sequence where the 5' and 3' primers begin may be varied to amplify a DNA segment encoding any desired portion of the complete protein shorter or longer than the mature form. The 3' primer has a sequence containing an appropriate restriction site followed by nucleotides complementary to the 3' end of the polypeptide coding sequence of Table 1, excluding a stop codon, with the coding sequence aligned with the restriction site so as to maintain its reading frame with that of the six His codons in the pQE60 vector.

The amplified *E. faecalis* DNA fragment and the vector pQE60 were digested with restriction enzymes which recognize the sites in the primers and the digested DNAs were then ligated together. The *E. faecalis* DNA was inserted into the restricted pQE60 vector in a manner which places the *E. faecalis* protein coding region downstream from the IPTG-inducible promoter and in-frame with an initiating AUG and the six histidine codons.

The ligation mixture was transformed into competent *E. coli* cells using standard procedures such as those described by Sambrook et al., supra. *E. coli* strain M15/rep4, containing multiple copies of the plasmid pREP4, which expresses the lac repressor and confers kanamycin resistance ("Kanr"), was used in carrying out the illustrative example described herein. This strain, which was only one of many that are suitable for expressing a *E. faecalis* polypeptide, is available commercially (QIAGEN, Inc., supra). Transformants were identified by their ability to grow on LB agar plates in the presence of ampicillin and kanamycin. Plasmid DNA was isolated from resistant colonies and the identity of the cloned DNA confirmed by restriction analysis, PCR and DNA sequencing.

Clones containing the desired constructs were grown overnight ("O/N") in liquid culture in LB media supplemented with both ampicillin (100 µg/ml) and kanamycin (25 µg/ml). The O/N culture was used to inoculate a large culture, at a dilution of approximately 1:25 to 1:250. The cells were grown to an optical density at 600 nm ("OD600") of between 0.4 and 0.6. Isopropyl-β-D-thiogalactopyranoside ("IPTG") was then added to a final concentration of 1 mM to induce transcription from the lac repressor sensitive promoter, by inactivating the lacI repressor. Cells subsequently were incubated further for 3 to 4 hours. Cells then were harvested by centrifugation.

The cells were then stirred for 3–4 hours at 4° C. in 6M guanidine-HCl, pH 8. The cell debris was removed by centrifugation, and the supernatant containing the *E. faecalis* polypeptide was loaded onto a nickel-nitrilo-tri-acetic acid ("Ni-NTA") affinity resin column (QIAGEN, Inc., supra). Proteins with a 6×His tag bind to the Ni-NTA resin with high affinity were purified in a simple one-step procedure (for details see: The QIAexpressionist, 1995, QIAGEN, Inc., supra). Briefly the supernatant was loaded onto the column in 6 M guanidine-HCl, pH 8, the column was first washed with 10 volumes of 6 M guanidine-HCl, pH 8, then washed with 10 volumes of 6 M guanidine-HCl pH 6, and finally the *E. faecalis* polypeptide was eluted with 6 M guanidine-HCl, pH 5.

The purified protein was then renatured by dialyzing it against phosphate-buffered saline (PBS) or 50 mM Na-acetate, pH 6 buffer plus 200 mM NaCl. Alternatively, the protein could be successfully refolded while immobilized on the Ni-NTA column. The recommended conditions are as follows: renature using a linear 6M–1M urea gradient in 500 mM NaCl, 20% glycerol, 20 mM Tris/HCl pH 7.4, containing protease inhibitors. The renaturation should be performed over a period of 1.5 hours or more. After renaturation the proteins can be eluted by the addition of 250 mM immidazole. Immidazole was removed by a final dialyzing step against PBS or 50 mM sodium acetate pH 6 buffer plus 200 mM NaCl. The purified protein was stored at 4° C. or frozen at −80° C.

Some of the polypeptide of the present invention were prepared using a non-denaturing protein purification method. For these polypeptides, the cell pellet from each liter of culture was resuspended in 25 mls of Lysis Buffer A at 4° C. (Lysis Buffer A=50 mM Na-phosphate, 300 mM NaCl, 10 mM 2-mercaptoethanol, 10% Glycerol, pH 7.5 with 1 tablet of Complete EDTA-free protease inhibitor cocktail (Boehringer Mannheim #1873580) per 50 ml of buffer). Absorbance at 550 nm was approximately 10–20 O.D./ml. The suspension was then put through three freeze/thaw cycles from −70° C. (using a ethanol-dry ice bath) up to room temperature. The cells were lysed via sonication in short 10 sec bursts over 3 minutes at approximately 80 W while kept on ice. The sonicated sample was then centrifuged at 15,000 RPM for 30 minutes at 4° C. The supernatant was passed through a column containing 1.0 ml of CL-4B resin to pre-clear the sample of any proteins that may bind to agarose non-specifically, and the flow-through fraction was collected.

The pre-cleared flow-through was applied to a nickel-nitrilo-tri-acetic acid ("Ni-NTA") affinity resin column (Quiagen, Inc., supra). Proteins with a 6×His tag bind to the Ni-NTA resin with high affinity and can be purified in a simple one-step procedure. Briefly, the supernatant was loaded onto the column in Lysis Buffer A at 4° C., the column was first washed with 10 volumes of Lysis Buffer A until the A280 of the eluate returns to the baseline. Then, the column was washed with 5 volumes of 40 mM Imidazole (92% Lysis Buffer A/8% Buffer B) (Buffer B=50 mM Na-Phosphate, 300 mM NaCl, 10% Glycerol, 10 mM 2-mercaptoethanol, 500 mM Imidazole, pH of the final buffer should be 7.5). The protein was eluted off of the column with a series of increasing Imidazole solutions made by adjusting the ratios of Lysis Buffer A to Buffer B. Three different concentrations were used: 3 volumes of 75 mM Imidazole, 3 volumes of 150 mM Imidazole, 5 volumes of 500 mM Imidazole. The fractions containing the purified protein were analyzed using 8 %, 10% or 14% SDS-PAGE depending on the protein size. The purified protein was then dialyzed 2× against phosphate-buffered saline (PBS) in order to place it into an easily workable buffer. The purified protein was stored at 4° C. or frozen at −80°.

The following alternative method may be used to purify *E. faecalis* expressed in *E. coli* when it is present in the form of inclusion bodies. Unless otherwise specified, all of the following steps are conducted at 4–10° C.

Upon completion of the production phase of the *E. coli* fermentation, the cell culture is cooled to 4–10° C. and the cells are harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells are then lysed by passing the solution through a microfluidizer (Microfluidics, Corp. or APV Gaulin, Inc.) twice at 4000–6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2–4 hours. After 7000×g centrifugation for 15 min., the pellet is discarded and the *E. faecalis* polypeptide-containing supernatant is incubated at 4° C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4° C. without mixing for 12 hours prior to further purification steps.

To clarify the refolded *E. faecalis* polypeptide solution, a previously prepared tangential filtration unit equipped with 0.16 μm membrane filter with appropriate surface area (e.g., Filtron), equilibrated with 40 mM sodium acetate, pH 6.0 is employed. The filtered sample is loaded onto a cation exchange resin (e.g., Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 mm of the effluent is continuously monitored. Fractions are collected and further analyzed by SDS-PAGE.

Fractions containing the *E. faecalis* polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the *E. faecalis* polypeptide (determined, for instance, by 16% SDS-PAGE) are then pooled.

The resultant *E. faecalis* polypeptide exhibits greater than 95% purity after the above refolding and purification steps. No major contaminant bands are observed from Commassie blue stained 16% SDS-PAGE gel when 5 μg of purified protein is loaded. The purified protein is also tested for endotoxin/LPS contamination, and typically the LPS content is less than 0.1 ng/ml according to LAL assays.

Example 2(b)
Alternative Expression and Purification Enterococcal Polypeptides in *E. coli*

The vector pQE10 was alternatively used to clone and express some of the polypeptides of the present invention for use in the soft tissue and systemic infection models discussed below. The difference being such that an inserted DNA fragment encoding a polypeptide expresses that polypeptide with the six His residues (i.e., a "6×His tag") covalently linked to the amino terminus of that polypeptide. The bacterial expression vector pQE10 (QIAGEN, Inc., 9259 Eton Avenue, Chatsworth, Calif., 91311) was used in this example. The components of the pQE10 plasmid are arranged such that the inserted DNA sequence encoding a polypeptide of the present invention expresses the polypeptide with the six His residues (i.e., a "6×His tag")) covalently linked to the amino terminus.

The DNA sequences encoding the desired portions of a polypeptide of Table 1 were amplified using PCR oligonucleotide primers from genomic *E. faecalis* DNA. The PCR primers anneal to the nucleotide sequences encoding the desired amino acid sequence of a polypeptide of the present invention. Additional nucleotides containing restriction sites to facilitate cloning in the pQE 10 vector were added to the 5' and 3' primer sequences, respectively.

For cloning a polypeptide of the present invention, the 5' and 3' primers were selected to amplify their respective nucleotide coding sequences. One of ordinary skill in the art would appreciate that the point in the protein coding sequence where the 5' and 3' primers begins may be varied to amplify a DNA segment encoding any desired portion of a polypeptide of the present invention. The 5' primer was designed so the coding sequence of the 6×His tag is aligned with the restriction site so as to maintain its reading frame with that of *E. faecalis* polypeptide. The 3' was designed to include an stop codon. The amplified DNA fragment was then cloned, and the protein expressed, as described above for the pQE60 plasmid.

The DNA sequences encoding the amino acid sequences of Table 1 may also be cloned and expressed as fusion proteins by a protocol similar to that described directly above, wherein the pET-32b(+) vector (Novagen, 601 Science Drive, Madison, Wis. 53711) is preferentially used in place of pQE10.

The above methods are not limited to the polypeptide fragements actually produced. The above method, like the methods below, can be used to produce either full length polypeptides or desired fragements therof.

Example 2(c)
Alternative Expression and Purification of Enterococcal Polypeptides in *E. coli*

The bacterial expression vector pQE60 is used for bacterial expression in this example (QIAGEN, Inc., 9259 Eton Avenue, Chatsworth, Calif., 9131 1). However, in this example, the polypeptide coding sequence is inserted such that translation of the six His codons is prevented and, therefore, the polypeptide is produced with no 6×His tag.

The DNA sequence encoding the desired portion of the *E. faecalis* amino acid sequence is amplified from an *E. faecalis* genomic DNA prep the deposited DNA clones using PCR oligonucleotide primers which anneal to the 5' and 3' nucleotide sequences corresponding to the desired portion of the *E. faecalis* polypeptides. Additional nucleotides containing restriction sites to facilitate cloning in the pQE60 vector are added to the 5' and 3' primer sequences.

For cloning a *E. faecalis* polypeptides of the present invention, 5' and 3' primers are selected to amplify their respective nucleotide coding sequences. One of ordinary skill in the art would appreciate that the point in the protein coding sequence where the 5' and 3' primers begin may be varied to amplify a DNA segment encoding any desired portion of a polypeptide of the present invention. The 3' and 5' primers contain appropriate restriction sites followed by nucleotides complementary to the 5' and 3' ends of the coding sequence respectively. The 3' primer is additionally designed to include an in-frame stop codon.

The amplified E. faecalis DNA fragments and the vector pQE60 are digested with restriction enzymes recognizing the sites in the primers and the digested DNAs are then ligated together. Insertion of the E. faecalis DNA into the restricted pQE60 vector places the E. faecalis protein coding region including its associated stop codon downstream from the IPTG-inducible promoter and in-frame with an initiating AUG. The associated stop codon prevents translation of the six histidine codons downstream of the insertion point.

The ligation mixture is transformed into competent E. coli cells using standard procedures such as those described by Sambrook et al. E. coli strain M15/rep4, containing multiple copies of the plasmid pREP4, which expresses the lac repressor and confers kanamycin resistance ("Kanr"), is used in carrying out the illustrative example described herein. This strain, which is only one of many that are suitable for expressing E. faecalis polypeptide, is available commercially (QIAGEN, Inc., supra). Transformants are identified by their ability to grow on LB plates in the presence of ampicillin and kanamycin. Plasmid DNA is isolated from resistant colonies and the identity of the cloned DNA confirmed by restriction analysis, PCR and DNA sequencing.

Clones containing the desired constructs are grown overnight ("O/N") in liquid culture in LB media supplemented with both ampicillin (100 µg/ml) and kanamycin (25 µg/ml). The O/N culture is used to inoculate a large culture, at a dilution of approximately 1:25 to 1:250. The cells are grown to an optical density at 600 nm ("OD600") of between 0.4 and 0.6. isopropyl-b-D-thiogalactopyranoside ("IPTG") is then added to a final concentration of 1 mM to induce transcription from the lac repressor sensitive promoter, by inactivating the lad repressor. Cells subsequently are incubated further for 3 to 4 hours. Cells then are harvested by centrifugation.

To purify the E. faecalis polypeptide, the cells are then stirred for 3–4 hours at 4° C. in 6M guanidine-HCl, pH 8. The cell debris is removed by centrifugation, and the supernatant containing the E. faecalis polypeptide is dialyzed against 50 mM Na-acetate buffer pH 6, supplemented with 200 mM NaCl. Alternatively, the protein can be successfully refolded by dialyzing it against 500 mM NaCl, 20% glycerol, 25 mM Tris/HCl pH 7.4, containing protease inhibitors. After renaturation the protein can be purified by ion exchange, hydrophobic interaction and size exclusion chromatography. Alternatively, an affinity chromatography step such as an antibody column can be used to obtain pure E. faecalis polypeptide. The purified protein is stored at 4° C. or frozen at −80° C.

The following alternative method may be used to purify E. faecalis polypeptides expressed in E. coli when it is present in the form of inclusion bodies. Unless otherwise specified, all of the following steps are conducted at 4–10° C.

Upon completion of the production phase of the E. coli fermentation, the cell culture is cooled to 4–10° C. and the cells are harvested by continuous centrifugation at 15,000 rpm (Heraeus Sepatech). On the basis of the expected yield of protein per unit weight of cell paste and the amount of purified protein required, an appropriate amount of cell paste, by weight, is suspended in a buffer solution containing 100 mM Tris, 50 mM EDTA, pH 7.4. The cells are dispersed to a homogeneous suspension using a high shear mixer.

The cells ware then lysed by passing the solution through a microfluidizer (Microfuidics, Corp. or APV Gaulin, Inc.) twice at 4000–6000 psi. The homogenate is then mixed with NaCl solution to a final concentration of 0.5 M NaCl, followed by centrifugation at 7000×g for 15 min. The resultant pellet is washed again using 0.5M NaCl, 100 mM Tris, 50 mM EDTA, pH 7.4.

The resulting washed inclusion bodies are solubilized with 1.5 M guanidine hydrochloride (GuHCl) for 2–4 hours. After 7000×g centrifugation for 15 min., the pellet is discarded and the E. faecalis polypeptide-containing supernatant is incubated at 4° C. overnight to allow further GuHCl extraction.

Following high speed centrifugation (30,000×g) to remove insoluble particles, the GuHCl solubilized protein is refolded by quickly mixing the GuHCl extract with 20 volumes of buffer containing 50 mM sodium, pH 4.5, 150 mM NaCl, 2 mM EDTA by vigorous stirring. The refolded diluted protein solution is kept at 4° C. without mixing for 12 hours prior to further purification steps.

To clarify the refolded E. faecalis polypeptide solution, a previously prepared tangential filtration unit equipped with 0.16 µm membrane filter with appropriate surface area (e.g., Filtron), equilibrated with 40 mM sodium acetate, pH 6.0 is employed. The filtered sample is loaded onto a cation exchange resin (e.g., Poros HS-50, Perseptive Biosystems). The column is washed with 40 mM sodium acetate, pH 6.0 and eluted with 250 mM, 500 mM, 1000 mM, and 1500 mM NaCl in the same buffer, in a stepwise manner. The absorbance at 280 mm of the effluent is continuously monitored. Fractions are collected and further analyzed by SDS-PAGE.

Fractions containing the E. faecalis polypeptide are then pooled and mixed with 4 volumes of water. The diluted sample is then loaded onto a previously prepared set of tandem columns of strong anion (Poros HQ-50, Perseptive Biosystems) and weak anion (Poros CM-20, Perseptive Biosystems) exchange resins. The columns are equilibrated with 40 mM sodium acetate, pH 6.0. Both columns are washed with 40 mM sodium acetate, pH 6.0, 200 mM NaCl. The CM-20 column is then eluted using a 10 column volume linear gradient ranging from 0.2 M NaCl, 50 mM sodium acetate, pH 6.0 to 1.0 M NaCl, 50 mM sodium acetate, pH 6.5. Fractions are collected under constant $A_{280}$ monitoring of the effluent. Fractions containing the E. faecalis polypeptide (determined, for instance, by 16% SDS-PAGE) are then pooled.

The resultant E. faecalis polypeptide exhibits greater than 95% purity after the above refolding and purification steps. No major contaminant bands are observed from Commassie blue stained 16% SDS-PAGE gel when 5 µg of purified protein is loaded. The purified protein is also tested for endotoxin/LPS contamination, and typically the LPS content is less than 0.1 ng/ml according to LAL assays.

Example 2(d)

Cloning and Expression of E. faecalis in Other Bacteria

E. faecalis polypeptides can also be produced in: E. faecalis using the methods of S. Skinner et al., (1988) Mol. Microbiol. 2:289–297 or J. I. Moreno (1996) Protein Expr. Purif. 8(3):332–340; Lactobacillus using the methods of C. Rush et al., 1997 Appl. Microbiol. Biotechnol. 47(5):537–542; or in *Bacillus subtilis* using the methods Chang et al., U.S. Pat. No. 4,952,508.

Example 3
Cloning and Expression in COS Cells

A E. faecalis expression plasmid is made by cloning a portion of the DNA encoding a E. faecalis polypeptide into the expression vector pDNAI/Amp or pDNAIII (which can be obtained from Invitrogen, Inc.). The expression vector pDNAI/amp contains: (1) an E. coli origin of replication effective for propagation in E. coli and other prokaryotic cells; (2) an ampicillin resistance gene for selection of plasmid-containing prokaryotic cells; (3) an SV40 origin of replication for propagation in eukaryotic cells; (4) a CMV promoter, a polylinker, an SV40 intron; (5) several codons encoding a hemagglutinin fragment (i.e., an "HA" tag to facilitate purification) followed by a termination codon and polyadenylation signal arranged so that a DNA can be conveniently placed under expression control of the CMV promoter and operably linked to the SV40 intron and the polyadenylation signal by means of restriction sites in the polylinker. The HA tag corresponds to an epitope derived from the influenza hemagglutinin protein described by Wilson et al. 1984 Cell 37:767. The fusion of the HA tag to the target protein allows easy detection and recovery of the recombinant protein with an antibody that recognizes the HA epitope. pDNAIII contains, in addition, the selectable neomycin marker.

A DNA fragment encoding a E. faecalis polypeptide is cloned into the polylinker region of the vector so that recombinant protein expression is directed by the CMV promoter. The plasmid construction strategy is as follows. The DNA from a E. faecalis genomic DNA prep is amplified using primers that contain convenient restriction sites, much as described above for construction of vectors for expression of E. faecalis in E. coli . The 5' primer contains a Kozak sequence, an AUG start codon, and nucleotides of the 5' coding region of the E. faecalis polypeptide. The 3' primer, contains nucleotides complementary to the 3' coding sequence of the E. faecalis DNA, a stop codon, and a convenient restriction site.

The PCR amplified DNA fragment and the vector, pDNAI/Amp, are digested with appropriate restriction enzymes and then ligated. The ligation mixture is transformed into an appropriate E. coli strain such as SURE™ (Stratagene Cloning Systems, La Jolla, Calif. 92037), and the transformed culture is plated on ampicillin media plates which then are incubated to allow growth of ampicillin resistant colonies. Plasmid DNA is isolated from resistant colonies and examined by restriction analysis or other means for the presence of the fragment encoding the E. faecalis polypeptide.

For expression of a recombinant E. faecalis polypeptide, COS cells are transfected with an expression vector, as described above, using DEAE-dextran, as described, for instance, by Sambrook et al. (supra). Cells are incubated under conditions for expression of E. faecalis by the vector.

Expression of the E. faecalis-HA fusion protein is detected by radiolabeling and immunoprecipitation, using methods described in, for example Harlow et al., supra. To this end, two days after transfection, the cells are labeled by incubation in media containing $^{35}$S-cysteine for 8 hours. The cells and the media are collected, and the cells are washed and the lysed with detergent-containing RIPA buffer: 150 mM NaCl, 1% NP-40, 0.1% SDS, 1% NP-40, 0.5% DOC, 50 mM TRIS, pH 7.5, as described by Wilson et al. (supra). Proteins are precipitated from the cell lysate and from the culture media using an HA-specific monoclonal antibody. The precipitated proteins then are analyzed by SDS-PAGE and autoradiography. An expression product of the expected size is seen in the cell lysate, which is not seen in negative controls.

Example 4
Cloning and Expression in CHO Cells

The vector pC4 is used for the expression of E. faecalis polypeptide in this example. Plasmid pC4 is a derivative of the plasmid pSV2-dhfr (ATCC Accession No. 37146). The plasmid contains the mouse DHFR gene under control of the SV40 early promoter. Chinese hamster ovary cells or other cells lacking dihydrofolate activity that are transfected with these plasmids can be selected by growing the cells in a selective medium (alpha minus MEM, Life Technologies) supplemented with the chemotherapeutic agent methotrexate. The amplification of the DHFR genes in cells resistant to methotrexate (MTX) has been well documented. See, e.g., Alt et al., 1978, J. Biol. Chem. 253:1357–1370; Hamlin et al., 1990, Biochem. et Biophys. Acta, 1097:107–143; Page et al., 1991, Biotechnology 9:64–68. Cells grown in increasing concentrations of MTX develop resistance to the drug by overproducing the target enzyme, DHFR, as a result of amplification of the DHFR gene. If a second gene is linked to the DHFR gene, it is usually co-amplified and over-expressed. It is known in the art that this approach may be used to develop cell lines carrying more than 1,000 copies of the amplified gene(s). Subsequently, when the methotrexate is withdrawn, cell lines are obtained which contain the amplified gene integrated into one or more chromosome(s) of the host cell.

Plasmid pC4 contains the strong promoter of the long terminal repeat (LTR) of the Rouse Sarcoma Virus, for expressing a polypeptide of interest, Cullen, et al. (1985) Mol. Cell. Biol. 5:438–447; plus a fragment isolated from the enhancer of the immediate early gene of human cytomegalovirus (CMV), Boshart, et al., 1985, Cell 41:521–530. Downstream of the promoter are the following single restriction enzyme cleavage sites that allow the integration of the genes: Bam HI, Xba I, and Asp 718. Behind these cloning sites the plasmid contains the 3' intron and polyadenylation site of the rat preproinsulin gene. Other high efficiency promoters can also be used for the expression, e.g., the human β-actin promoter, the SV40 early or late promoters or the long terminal repeats from other retroviruses, e.g., HIV and HTLVI. Clontech's Tet-Off and Tet-On gene expression systems and similar systems can be used to express the E. faecalis polypeptide in a regulated way in mammalian cells (Gossen et al., 1992, Proc. Natl. Acad. Sci. USA 89:5547–5551. For the polyadenylation of the mRNA other signals, e.g., from the human growth hormone or globin genes can be used as well. Stable cell lines carrying a gene of interest integrated into the chromosomes can also be selected upon co-transfection with a selectable marker such as gpt, G418 or hygromycin. It is advantageous to use more than one selectable marker in the beginning, e.g., G418 plus methotrexate.

The plasmid pC4 is digested with the restriction enzymes and then dephosphorylated using calf intestinal phosphates by procedures known in the art. The vector is then isolated from a 1% agarose gel. The DNA sequence encoding the E. faecalis polypeptide is amplified using PCR oligonucleotide primers corresponding to the 5' and 3' sequences of the desired portion of the gene. A 5' primer containing a restriction site, a Kozak sequence, an AUG start codon, and nucleotides of the 5' coding region of the E. faecalis polypeptide is synthesized and used. A 3' primer, containing a restriction site, stop codon, and nucleotides complementary to the 3' coding sequence of the E. faecalis polypeptides is synthesized and used. The amplified fragment is digested with the restriction endonucleases and then purified again on a 1% agarose gel. The isolated fragment and the dephosphorylated vector are then ligated with T4 DNA ligase. *E. coli* HB101 or XL-1 Blue cells are then transformed and bacteria are identified that contain the fragment inserted into plasmid pC4 using, for instance, restriction enzyme analysis.

Chinese hamster ovary cells lacking an active DHFR gene are used for transfection. Five μg of the expression plasmid pC4 is cotransfected with 0.5 μg of the plasmid pSVneo using a lipid-mediated transfection agent such as Lipofectin™ or LipofectAMINE.™ (LifeTechnologies Gaithersburg, Md.). The plasmid pSV2-neo contains a dominant selectable marker, the neo gene from Tn5 encoding an enzyme that confers resistance to a group of antibiotics including G418. The cells are seeded in alpha minus MEM supplemented with 1 mg/ml G418. After 2 days, the cells are trypsinized and seeded in hybridoma cloning plates (Greiner, Germany) in alpha minus MEM supplemented with 10, 25, or 50 ng/ml of methotrexate plus 1 mg/ml G418. After about 10–14 days single clones are trypsinized and then seeded in 6-well petri dishes or 10 ml flasks using different concentrations of methotrexate (50 nM, 100 nM, 200 nM, 400 nM, 800 nM). Clones growing at the highest concentrations of methotrexate are then transferred to new 6-well plates containing even higher concentrations of methotrexate (1 μM, 2 μM, 5 μM, 10 mM, 20 mM). The same procedure is repeated until clones are obtained which grow at a concentration of 100–200 μM. Expression of the desired gene product is analyzed, for instance, by SDS-PAGE and Western blot or by reversed phase HPLC analysis.

Example 5

Quantitative Murine Soft Tissue Infection Model for *E. faecalis*

Compositions of the present invention, including polypeptides and peptides, are assayed for their ability to function as vaccines or to enhance/stimulate an immune response to a bacterial species (e.g., *E. faecalis*) using the following quantitative murine soft tissue infection model. Mice (e.g., NIH Swiss female mice, approximately 7 weeks old) are first treated with a biologically protective effective amount, or immune enhancing/stimulating effective amount of a composition of the present invention using methods known in the art, such as those discussed above. See,e.g, Harlow et al., ANTIBODIES: A LABORATORY MANUAL, (Cold Spring Harbor Laboratory Press, 2nd ed. 1988). An example of an appropriate starting dose is 20 ug per animal.

The desired bacterial species used to challenge the mice, such as *E. faecalis,* is grown as an overnight culture. The culture is diluted to a concentration of $5\times10^8$ cfu/ml, in an appropriate media, mixed well, serially diluted, and titered. The desired doses are further diliuted 1:2 with sterilized Cytodex 3 microcarrier beads preswollen in sterile PBS (3 g/100 ml). Mice are anesthetize briefly until docile, but still mobile and injected with 0.2 ml of the Cytodex 3 bead/bacterial mixture into each animal subcutaneously in the inguinal region. After four days, counting the day of injection as day one, mice are sacrificed and the contents of the abscess is excised and placed in a 15 ml conical tube containing 1.0 ml of sterile PBS. The contents of the abscess is then enzymatically treated and plated as follows.

The abscess is first disrupted by vortexing with sterilized glass beads placed in the tubes. 3.0 mls of prepared enzyme mixture (1.0 ml Collagenase D (4.0 mg/ml), 1.0 ml Trypsin (6.0 mg/ml) and 8.0 mls PBS) is then added to each tube followed by a 20 min. incubation at 37 C. The solution is then centrifuged and the supernatant drawn off. 0.5 ml dH20 is then added and the tubes are vortexed and then incubated for 10 min. at room temperature. 0.5 ml media is then added and samples are serially diluted and plated onto agar plates, and grown overnight at 37 C. Plates with distinct and separate colonies are then counted, compared to positive and negative control samples, and quantified. The method can be used to identify composition and determine appropriate and effective doses for humans and other animals by comparing the effective doses of compositions of the present invention with compositions known in the art to be effective in both mice and humans. Doses for the effective treatment of humans and other animals, using compositions of the present invention, are extrapolated using the data from the above experiments of mice. It is appreciated that further studies in humans and other animals may be needed to determine the most effective doses using methods of clinical practice known in the art.

Example 6

Murine Systemic Neutropenic Model for *E. faecalis* Infection

Compositions of the present invention, including polypeptides and peptides, are assayed for their ability to function as vaccines or to enhance/stimulate an immune response to a bacterial species (e.g., *E. faecalis*) using the following qualitative murine systemic neutropenic model. Mice (e.g., NIH Swiss female mice, approximately 7 weeks old) are first treated with a biologically protective effective amount, or immune enhancing/stimulating effective amount of a composition of the present invention using methods known in the art, such as those discussed above. See,e.g., Harlow et al., ANTIBODIES: A LABORATORY MANUAL, (Cold Spring Harbor Laboratory Press, 2nd ed. 1988). An example of an appropriate starting dose is 20 ug per animal. Mice are then injected with 250–300 mg/kg cyclophosphamide intraperitonially. Counting the day of C.P. injection as day one, the mice are left untreated for 5 days to begin recovery of PMNL'S.

The desired bacterial species used to challenge the mice, such as *E. faecalis,* is grown as an overnight culture. The culture is diluted to a concentration of $5\times10^8$ cfu/ml, in an appropriate media, mixed well, serially diluted, and titered. The desired doses are further diliuted 1:2 in 4% Brewer's yeast in media.

Mice are injected with the bacteria/brewer's yeast challenge intraperitonially. The Brewer's yeast solution alone is used as a control. The mice are then monitered twice daily for the first week following challenge, and once a day for the next week to ascertain morbidity and mortality. Mice remaining at the end of the experiment are sacrificed. The method can be used to identify compositions and determine appropriate and effective doses for humans and other animals by comparing the effective doses of compositions of the present invention with compositions known in the art to be effective in both mice and humans. Doses for the effective treatment of humans and other animals, using compositions of the present invention, are extrapolated using the data from the above experiments of mice. It is appreciated that further studies in humans and other animals may be needed to determine the most effective doses using methods of clinical practice known in the art.

The disclosure of all publications (including patents, patent applications, journal articles, laboratory manuals, books, or other documents) cited herein are hereby incorporated by reference in their entireties.

The present invention is not to be limited in scope by the specific embodiments described herein, which are intended as single illustrations of individual aspects of the invention. Functionally equivalent methods and components are within the scope of the invention, in addition to those shown and described herein and will become apparant to those skilled in the art from the foregoing description and accompanying drawings. Such modifications are intended to fall within the scope of the appended claims.

TABLE 1

| Nucleotide and Amino Acid Seqeuences of E. faecalis Genes. |
|---|

EF001-1 (SEQ ID NO:1)
TGAAAGAATA TTGCCAGAAC GTGGCGAGCA AATTGTTTTA TAAATTTTTT TAAGGGAGAG
AAAAAAATGA AGTTCAAAAC TCTAGCAACA ACAGTGTTAG CAACCGCAGC TATTTTCGCA
TTGGGGGCTT GTGGTAACGG TAATGGGGCC AAAGAATCAA ACGATATTGT GAAAGAAGTG
AAGGAAGATA CGACAATCAC TTTCTGGCAT GCAATGAATG GGGTTCAAGA AGAAGCGTTA
ACAAAATTAA CGAAAGACTT CATGAAAGAA AATCCAAAAA TTAAAGTGGA ATTACAAAAT
CAATCTGCTT ACCCTGATTT ACAAGCCAAA ATCAATTCGA CTTTAACTTC ACCAAAAGAT
TTACCAACAA TTACGCAAGC GTACCCAGGC TGGTTATGGA ATGCTGCACA AGATGAAATG
TTAGTGGACT TAAAACCATA TATGGATGAT GACACAATCG GCTGGAAAGA TGCAGAGCCA
ATTCGTGAAG TATTGTTAGA CCGCGCCAAA ATCGACGGCA AACAATACGG CATTCCATTT
AATAAATCGA CAGAAATGTT ATTCTATAAT GCTGATTTGT TGAAAGAATA TGGTGTTGAA
GTACCGAAAA CATTAGAGGA ATTAAAAGAA GCTTCTAAAA CAATTTACGA AAAATCCAAC
AAAGAAGTCG TTGGTGCTGG TTTTGACTCG TTAAATAACT ATTACGCAAT TGGAATGAAA
AACAAAGGCG TTGATTTTAA TAAAGACTTA GATTTAACAA GCAAAGATTC ACAAGAAGTC
GTGGACTATT ACCGTGATGG TATCGAAGCA GGTTACTTCC GCACAGCTGG TTCAGATAAA
TATTTATCTG GCCCATTTGC AAACAAAAAG GTAGCAATGT TTGTCGGTAG TATTGCTGGT
GCTGGTTTTG TTCAAAAAGA TGCTGAAGCT GGTGGCTATG AATACGGTGT TGCACCACGT
CCTGAAAAAA TCAACTTACA ACAAGGAACA GATATTTATA TGTTCGATAG TGCTACGCCA
GAACAACGGA CAGCGGCATT TGAATTCATG AAATTCTTAG CTACTCCTGA TTCACAATTG
TACTGGGCAC AACAAACAGG TTATATGCCA ATTTTAGAAT CTGTTTTACA CAGTGATGAG
TACAAAAATT CTAAGACAAC CAAAGTACCT GCACAACTTG AAAACGCAGT AAAAGATTTA
TTCGCTATCC CAGTAGAAGA AAATGCTGAT TCAGCCTATA ATGAAATGCG GACAATTATG
GAAAGTATTT TTGCTTCATC AAATAAAGAC ACGAGAAAAT TATTGAAAGA TGCAACATCA
CAATTTGAAC AAGCATGGAA CCAATAA

EF001-2 (SEQ ID NO:2)
MKFKTLATT VLATAAIFAL GACGNGNGAK ESNDIVKEVK
EDTTITFWHA MNGVQEEALT KLTKDFMKEN PKIKVELQNQ SAYPDLQAKI NSTLTSPKDL
PTITQAYPGW LWNAAQDEML VDLKPYMDDD TIGWKDAEPI REVLLDGAKI DGKQYGIPFN
KSTEMLFYNA DLLKEYGVEV PKTLEELKEA SKTIYEKSNK EVVGAGFDSL NNYYAIGMKN
KGVDFNKDLD LTSKDSQEVV DYYRDGIEAG YFRTAGSDKY LSGPFANKKV AMFVGSIAGA
GFVQKDAEAG GYEYGVAPRP EKINLQQGTD IYMFDSATPE QRTAAFEFMK FLATPDSQLY
WAQQTGYMPI LESVLHSDEY KNSKTTKVPA QLENAVKDLF AIPVEENADS AYNEMRTIME
SIFASSNKDT RKLLKDATSQ FEQAWNQ

EF001-3 (SEQ ID NO:3)
TT GTGGTAACGG TAATGGGCC AAAGAATCAA ACGATATTGT GAAAGAAGTG
AAGGAAGATA CGACAATCAC TTTCTGGCAT GCAATGAATG GGGTTCAAGA AGAAGCGTTA
ACAAAATTAA CGAAAGACTT CATGAAAGAA AATCCAAAAA TTAAAGTGGA ATTACAAAAT
CAATCTGCTT ACCCTGATTT ACAAGCCAAA ATCAATTCGA CTTTAACTTC ACCAAAAGAT
TTACCAACAA TTACGCAAGC GTACCCAGGC TGGTTATGGA ATGCTGCACA AGATGAAATG
TTAGTGGACT TAAAACCATA TATGGATGAT GACACAATCG GCTGGAAAGA TGCAGAGCCA
ATTCGTGAAG TATTGTTAGA CGGCGCCAAA ATCGACGGCA AACAATACGG CATTCCATTT
AATAAATCGA CAGAAATGTT ATTCTATAAT GCTGATTTGT TGAAAGAATA TGGTGTTGAA
GTACCGAAAA CATTAGAGGA ATTAAAAGAA GCTTCTAAAA CAATTTACGA AAAATCCAAC
AAAGAAGTCG TTGGTGCTGG TTTTGACTCG TTAAATAACT ATTACGCAAT TGGAATGAAA
AACAAAGGCG TTGATTTTAA TAAAGACTTA GATTTAACAA GCAAAGATTC ACAAGAAGTC
GTGGACTATT ACCGTGATGG TATCGAAGCA GGTTACTTCC GCACAGCTGG TTCAGATAAA
TATTTATCTG GCCCATTTGC AAACAAAAAG GTAGCAATGT TTGTCGGTAG TATTGCTGGT
GCTGGTTTTG TTCAAAAAGA TGCTGAAGCT GGTGGCTATG AATACGGTGT TGCACCACGT
CCTGAAAAAA TCAACTTACA ACAAGGAACA GATATTTATA TGTTCGATAG TGCTACGCCA
GAACAACGGA CAGCGGCATT TGAATTCATG AAATTCTTAG CTACTCCTGA TTCACAATTG
TACTGGGCAC AACAAACAGG TTATATGCCA ATTTTAGAAT CTGTTTTACA CAGTGATGAG
TACAAAAATT CTAAGACAAC CAAAGTACCT GCACAACTTG AAAACGCAGT AAAAGATTTA
TTCGCTATCC CAGTAGAAGA AAATGCTGAT TCAGCCTATA ATGAAATGCG GACAATTATG
GAAAGTATTT TTGCTTCATC AAATAAAGAC ACGAGAAAAT TATTGAAAGA TGCAACATCA
CAATTTGAAC AAGCATGGAA CCAA

EF001-4 (SEQ ID NO:4)
CGNGNGAK ESNDIVKEVK
EDTTITFWHA MNGVQEEALT KLTKDFMKEN PKIKVELQNQ SAYPDLQAKI NSTLTSPKDL
PTITQAYPGW LWNAAQDEML VDLKPYMDDD TIGWKDAEPI REVLLDGAKI DGKQYGIPFN
KSTEMLFYNA DLLKEYGVEV PKTLEELKEA SKTIYEKSNK EVVGAGFDSL NNYYAIGMKN
KGVDFNKDLD LTSKDSQEVV DYYRDGIEAG YFRTAGSDKY LSGPFANKKV AMFVGSIAGA
GFVQKDAEAG GYEYGVAPRP EKINLQQGTD IYMFDSATPE QRTAAFEFMK FLATPDSQLY
WAQQTGYMPI LESVLHSDEY KNSKTTKVPA QLENAVKDLF AIPVEENADS AYNEMRTIME
SIFASSNKDT RKLLKDATSQ FEQAWNQ

EF002-1 (SEQ ID NO:5)
TAAATAGCGG AGGTAGTACA AATGAAATTT TGGAAAAAAG GCTTAACAGC GGCAGCGCTG
TTAGCAGTGG CGGCAGTAAC TTTAACAGCA TGTGGTGGTT CAAGTGAAAA GAAAGCAACT
GAAAAGAGTG AAGATGGCAA AACAAAATTA ACAGTAACTA CTTGGAATTA TGACACGACC
CCAGAATTTG AGAAATTATT CAGAGCTTTT GAAGCGGAAA ATCCTGATAT CACTATTGAA
CCGGTGGACA TTGCTTCAGA TGATTATGAC ACAAAAGTAA CAACGATGCT TTCATCAGGA
GATACGACGG ATATTTTAAC CATGAAAAAC TTACTTTCAT ATTCTAATTA CGCGCTACGC
AATCAATTGG TGGATTTAAC CGATCACGTT AAAGATTTAG ATATCGAACC TGCCAAAGCA
AGTTACGAGA TGTATGAAAT CGATGGTAAA ACCTATGCTC AGCCTTACCG TACAGATTTC

TABLE 1-continued

Nucleotide and Amino Acid Seqeuences of *E. faecalis* Genes.

```
TGGGTATTGT ATTACAATAA AAAAATGTTT GATGAAGCCG GAATTGCCTA TCCCGATAAC
TTAACTTGGG ATGAATATGA AGCGTTAGCG AAAAAATTAT CTAAACCAGA AGAACAAGTA
TATGGTGCCT ATCAACATAC TTGGCGCTCA ACCGTTCAAG CGATTGCTGC TGCTCAAAAC
AATGCCAATT TGATTGAACC AAAATACAAT TATATGGAAA CTTATTATGA TCGCGCATTG
AGAATGCAAA AAGATCAATC ACAAATGGAT TTTGGAACAG CAAAATCAAC AAAAGTAACG
TATCAATCAC AATTTGAAAA TTCAAAAGCG GCGATGATGT ACATGGGTAG CTGGTACATG
GGGACTTTAT TAACAAACAT TGATGATGGC AAAACAAATG TCGAATGGGG GATTGCCGAA
ATACCACAAC AAGAAAAAGG CAAAGCAACT ACCTTTGGCT CACCGACAAG TTTTGCAATT
AATAAAAACA GTAAAAAACA AAAAGCTGCT CAAAAATTCT TAGACTTTGC TTCAGGTAAA
GAAGGTGCAA AACTTTTAGC AGAAGTAGGG GTGGTTCCTT CTTATAAAAC AGATGAAATT
GATAAAATCT ACTTTGCAAG AAAAGGAATG CCTTCAGACG AGTCTCACAA AAAGCCTTTA
ACCCAGATAC AATTAATTTA G

EF002-2 (SEQ ID NO:6)
MKFW KKGLTAAALL AVAAVTLTAC GGSSEKKATE KSEDGKTKLT VTTWNYDTTP
EFEKLFRAFE AENPDITIEP VDIASDDYDT KVTTMLSSGD TTDILTMKNL LSYSNYALRN
QLVDLTDHVK DLDIEPAKAS YEMYEIDGKT YAQPYRTDFW VLYYNKKMFD EAGIAYPDNL
TWDEYEALAK KLSKPEEQVY GAYQHTWRST VQAIAAAQNN ANLIEPKYNY METYYDRALR
MQKDQSQMDF GTAKSTKVTY QSQFENSKAA MMYMGSWYMG TLLTNIDDGK TNVEWGIAEI
PQQEKGKATT FGSPTSFAIN KNSKKQKAAQ KFLDFASGKE GAKLLAEVGV VPSYKTDEID
KIYFARKGMP SDESHKKPLT QIQLI

EF002-3 (SEQ ID NO:7)
A TGTGGTGGTT CAAGTGAAAA GAAAGCAACT
GAAAAGAGTG AAGATGGCAA AACAAAATTA ACAGTAACTA CTTGGAATTA TGACACGACC
CCAGAATTTG AGAAATTATT CAGAGCTTTT GAAGCGAAAA ATCCTGATAT CACTATTGAA
CCGGTGGACA TTGCTTCAGA TGATTATGAC ACAAAAGTAA CAACGATGCT TTCATCAGGA
GATACGACGG ATATTTTAAC CATGAAAAAC TTACTTTCAT ATTCTAATTA CGCGCTACGC
AATCAATTGG TGGATTTAAC CGATCACGTT AAAGATTTAG ATATCGAACC TGCCAAAGCA
AGTTACGAGA TGTATGAAAT CGATGGTAAA ACCTATGCTC AGCCTTACCG TACAGATTTC
TGGGTATTGT ATTACAATAA AAAAATGTTT GATGAAGCCG GAATTGCCTA TCCCGATAAC
TTAACTTGGG ATGAATATGA AGCGTTAGCG AAAAAATTAT CTAAACCAGA AGAACAAGTA
TATGGTGCCT ATCAACATAC TTGGCGCTCA ACCGTTCAAG CGATTGCTGC TGCTCAAAAC
AATGCCAATT TGATTGAACC AAAATACAAT TATATGGAAA CTTATTATGA TCGCGCATTG
AGAATGCAAA AAGATCAATC ACAAATGGAT TTTGGAACAG CAAAATCAAC AAAAGTAACG
TATCAATCAC AATTTGAAAA TTCAAAAGCG GCGATGATGT ACATGGGTAG CTGGTACATG
GGGACTTTAT TAACAAACAT TGATGATGGC AAAACAAATG TCGAATGGGG GATTGCCGAA
ATACCACAAC AAGAAAAAGG CAAAGCAACT ACCTTTGGCT CACCGACAAG TTTTGCAATT
AATAAAAACA GTAAAAAACA AAAAGCTGCT CAAAAATTCT TAGACTTTGC TTCAGGTAAA
GAAGGTGCAA AACTTTTAGC AGAAGTAGGG GTGGTTCCTT CTTATAAAAC AGATGAAATT
GATAAAATCT ACTTTGCAAG AAAAGGAATG CCTTCAGACG AGTCTCACAA AAAGCCTTTA
ACCCAGATAC AATTAATT

EF002-4 (SEQ ID NO:8)
C GGSSEKKATE KSEDGKTKLT VTTWNYDTTP
EFEKLFRAFE AENPDITIEP VDIASDDYDT KVTTMLSSGD TTDILTMKNL LSYSNYALRN
QLVDLTDHVK DLDIEPAKAS YEMYEIDGKT YAQPYRTDFW VLYYNKKMFD EAGIAYPDNL
TWDEYEALAK KLSKPEEQVY GAYQHTWRST VQAIAAAQNN ANLIEPKYNY METYYDRALR
MQKDQSQMDF GTAKSTKVTY QSQFENSKAA MMYMGSWYMG TLLTNIDDGK TNVEWGIAEI
PQQEKGKATT FGSPTSFAIN KNSKKQKAAQ KFLDFASGKE GAKLLAEVGV VPSYKTDEID
KIYFARKGMP SDESHKKPLT QIQLI

EF003-1 (SEQ ID NO:9)
TAGGAGGACA AAAGAATGAA GAAGTTTTAT TTAGCNACAT TCGCTGTTAT TGCAACAGTT
ATTTTAGCTG CCTGTGGGGG AAATAAACAA GCAGACCAGA AGAAGACAA GGAGATTACC
GTTGCCGTGC AATTGGAATC TTCAAAAGAT ATCTTGGAGA TTGCCAAGAA AGAAGCTGAG
AAAAAAGGGT ACAAAATTAA CATTATGGAA GTGAGCGACA ATGTTGCCTA CAACGATGCC
GTGCAACATG ACGAAGCGGA TGCTAATTTT GCGCAACATC AACCCTTCAT GGAAATGTTT
AACAAAGAGA AAAAAGCTGA TTTAGTGGCT GTGCAACCGA TTTATTATTT TGCTGGTGGT
TTCTATTCAA AAGAATACCA AGATGCGAAA GATTTACCTG AAAATGCCAA AGTGGGGATT
CCTAGCGATC CAACCAATGA AGGTCGTGCT TTAGCAATTT TAAATGCAAA CGGCGTGATT
AAATTAAAAG AAGGTGTCGG CTTTAACGGC ACGGTGGCAG ATGTCGTGGA AAATCCTAAA
AACATCACTT TTGAAAGCAT TGATTTACTG AATTTAGCTA AAGCCTATGA TGAAAAAGAC
ATCGCTATGG TGTTCTGCTA CCCAGCCTAC TTGAACCTG CTGGTTTAAC AACGAAAGAT
GCGATCTTGT TAGAAGATAA AGAAGCAAGT AAACATTACG CATTGCAAGT TGTGACACGC
AAAGGCGAAA AAGATAGCGA AAAAATCAAG GTTTTAAAAG AAGCGATGAC AACAAAAGAA
GTTGCTGAAT ACATCAAGAA AAATTCTAAA GGCGCCAATA TTCCTGCGTT TTAA

EF003-2 (SEQ ID NO:10)
MKKFYL ATFAVIATVI LAACGGNKQA DQKEDKEITV AVQLESSKDI LEIAKKEAEK
KGYKINIMEV SDNVAYNDAV QHDEADANFA QHQPFMEMFN KEKKADLVAV QPIYYFAGGF
YSKEYQDAKD LPENAkVGIP SDPTNEGRAL AILNANGVIK LKEGVGFNGT VADVVENPKN
ITFESIDLLN LAKAYDEKDI ANVFCYPAYL EPAGLTTKDA ILLEDKEASK HYALQVVTRK
GEKDSEKIKV LKEAMTTKEV AEYIKKNSKG ANIPAF

EF003-3 (SEQ ID NO:11)
CTGTGGGGG AAATAAACAA GCAGACCAGA AGAAGACAA GGAGATTACC
```

TABLE 1-continued

Nucleotide and Amino Acid Seqeuences of *E. faecalis* Genes.

```
GTTGCCGTGC AATTGGAATC TTCAAAAGAT ATCTTGGAGA TTGCCAAGAA AGAAGCTGAG
AAAAAAGGGT ACAAAATTAA CATTATGGAA GTGAGCGACA ATGTTGCCTA CAACGATGCC
GTGCAACATG ACGAAGCGGA TGCTAATTTT GCGCAACATC AACCCTTCAT GGAAATGTTT
AACAAAGAGA AAAAAGCTGA TTTAGTGGCT GTGCAACCGA TTTATTATTT TGCTGGTGGT
TTCTATTCAA AGAATACCA AGATGCGAAA GATTTACCTG AAAATGCCAA AGTGGGGATT
CCTAGCGATC CAACCAATGA AGGTCGTGCT TTAGCAATTT TAAATGCAAA CGGCGTGATT
AAATTAAAAG AAGGTGTCGG CTTTAACGGC ACGGTGGCAG ATGTCGTGGA AAATCCTAAA
AACATCACTT TTGAAAGCAT TGATTTACTG AATTTAGCTA AAGCCTATGA TGAAAAAGAC
ATCGCTATGG TGTTCTGCTA CCCAGCCTAC TTAGAACCTG CTGGTTTAAC AACGAAAGAT
GCGATCTTGT TAGAAGATAA AGAAGCAAGT AAACATTACG CATTGCAAGT TGTGACACGC
AAAGGCGAAA AAGATAGCGA AAAAATCAAG GTTTTAAAAG AAGCGATGAC AACAAAAGAA
GTTGCTGAAT ACATCAAGAA AAATTCTAAA GGCGCCAATA TTCCTGCGTT T

EF003-4 (SEQ ID NO:12)
CGGNKQA DQKEDKEITV AVQLESSKDI LEIAKKEAEK
KGYKINIMEV SDNVAYNDAV QHDEADANFA QHQPFMEMFN KEKKADLVAV QPIYYFAGGF
YSKEYQDAKD LPENAKVGIP SDPTNEGRAL AILNANGVIK LKEGVGFNGT VADVVENPKN
ITFESIDLLN LAKAYDEKDI ANVFCYPAYL EPAGLTTKDA ILLEDKEASK HYALQVVTRK
GEKDSEKIKV LKEAMTTKEV AEYIKKNSKG ANIPAF

EF004-1 (SEQ ID NO:13)
TAAATCGAAA GAAGGATGAT AGAAATGAAA AAAATGATTA AATTTGCAGG CATTGCTCTT
ATTTTTGCAG CTCTTCTCTC TGCCTGTAGC AACGCAAAAA ATAATACACA AAAGAAAGCC
GAAACTGCTG CCCAGTCAAG CACTATTGAA GCTTCAGACA GTAACGAAAA CGAGCCTAAT
ACAGAAAACA TAACCCAAGC AGTTAAACAG TTAGAAGAAA AATTTAACTC TGACGAGAAA
TTAGTAAAAA TAGATGTTAA AAATAATGTT AAAGATGACA CATCAGATAA CCCTCACGCT
GTCATTACGG TTAAGGTAAT TAATGATGAA GCAAAAAAAA ATATGGAAGA AATGCAGACT
GCGATAGATT CCAACTCAGG TACAGAGGCA CAAAAGACTG CCATATACGG AATTCAATTA
AATGTTGAAG AAGTAGCCAA AACATTAGAA AATGATAACG ATGTTATTTC TTTCATCACA
CCTTACACGA ATGGGAACGA CAGAACCATA GCAAAATCAA CTAAAAATGA AAATATTATT
CCGTTAGTAA AATAA

EF004-2 (SEQ ID NO:14)
MKK MIKFAGIALI FAALLSACSN AKNNTQKKAE TAAQSSTIEA SDSNENEPNT
ENITQAVKQL EEKFNSDEKL VKIDVKNNVK DDTSDNPHAV ITVKVINDEA KKNMEEMQTA
IDSNSGTEAQ KTAIYGIQLN VEEVAKTLEN DNDVISFITP YTNGNDRTIA KSTKNENIIP
LVK

EF004-3 (SEQ ID NO:15)
CTGTAGC AACGCAAAAA ATAATACACA AAAGAAAGCC
GAAACTGCTG CCCAGTCAAG CACTATTGAA GCTTCAGACA GTAACGAAAA CGAGCCTAAT
ACAGAAAACA TAACCCAAGC AGTTAAACAG TTAGAAGAAA AATTTAACTC TGACGAGAAA
TTAGTAAAAA TAGATGTTAA AAATAATGTT AAAGATGACA CATCAGATAA CCCTCACGCT
GTCATTACGG TTAAGGTAAT TAATGATGAA GCAAAAAAAA ATATGGAAGA AATGCAGACT
GCGATAGATT CCAACTCAGG TACAGAGGCA CAAAAGACTG CCATATACGG AATTCAATTA
AATGTTGAAG AAGTAGCCAA AACATTAGAA AATGATAACG ATGTTATTTC TTTCATCACA
CCTTACACGA ATGGGAACGA CAGAACCATA GCAAAATCAA CTAAAAATGA AAATATTATT
CCGTTAGTAA AA

EF004-4 (SEQ ID NO:16)
CSN AKNNTQKKAE TAAQSSTIEA SDSNENEPNT
ENITQAVKQL EEKFNSDEKL VKIDVKNNVK DDTSDNPHAV ITVKVINDEA KKNMEEMQTA
IDSNSGTEAQ KTAIYGIQLN VEEVAKTLEN DNDVISFITP YTNGNDRTIA KSTKNENIIP
LVK

EF005-1 (SEQ ID NO:17)
TAAAAAATGA AAAAACGATT GACGATTGTG GGGATGCTTT TTCTGGCCAT TTAGTAATG
GTTGGTTGTG GTAAAAATCA GCAAGCAACG ACAAAAGAAA AAGAGACAAA ACCTGAAGAA
CTAACTCTTT ACATTGTGCG CCACGGAAAA ACCATGTTAA ATACGACGGA CCGCGTACAA
GGATGGTCAG ATGCGGTCCT AACACCAGAA GGTGAAAAAG TTGTGACAGC AACTGGGATT
GGACTGAAAG ATGTTGCCTT TCAAAATGCA TATAGTAGTG ATAGTGGCCG CGCCTTGCAA
ACTGCTCAAC TTATTTTAGA TCAAAATAAA GCAGGCAAAG ACCTTGAAGT CGTGCGTGAC
CCAGATTTAC GTGAATTTAA TTTTGGTAGC TATGAAGGGG ATTTAAATAA GACAATGTGG
CAGGATATTG CTGATGATCA AGGTGTTTCC TTAGAAGAAT TTATGAAAAA CATGACTCCT
GAATCCTTTG CCAATAGTGT AGCTAAACTG GATCAACAGC GCGAGGAAAG CAAGAATAAC
TGGCCTGCAG AAGACTATGC TACAATTACT AAACGTTTGA AAAAGGCTT AGATAAAATT
GTTGCCACAG AATCAGCCAA TTCTGGGAAT GGCAATGTTT TAGTGGTCTC TCATGGCTTG
AGTATTTCAG CGTTGTTAGC AACTTTATTT GATGATTTTA AAGTCCCAGA AGGCGGTTTG
AAGAATGCTA GTGTCACAAC AATTCATTAC AAAAATGGCG AATATACTTT GGATAAAGTC
AATGATGTCA GCTACTTAGA AGCAGGCGAA AAAGAATCAA AATAA

EF005-2 (SEQ ID NO:18)
MKKRLTIVG MLFLAILVMV GCGKNQQATT KEKETKPEEL TLYIVRHGKT MLNTTDRVQG
WSDAVLTPEG EKVVTATGIG LKDVAFQNAY SSDSGRALQT AQLILDQNKA GKDLEWRDP
DLREFNFGSY EGDLNKTMWQ DIADDQGVSL EEFMKNMTPE SFANSVAKLD QQREESKNNW
PAEDYATITK RLKKGLDKIV ATESANSGNG NVLVVSHGLS ISALLATLFD DFKVPEGGLK
NASVTTIHYK NGEYTLDKVN DVSYLEAGEK ESK
```

TABLE 1-continued

Nucleotide and Amino Acid Seqeuences of E. faecalis Genes.

EF005-3 (SEQ ID NO:19)
TTGTG GTAAAAATCA GCAAGCAACG ACAAAAGAAA AAGAGACAAA ACCTGAAGAA
CTAACTCTTT ACATTGTGCG CCACGGAAAA ACCATGTTAA ATACGACGGA CCGCGTACAA
GGATGGTCAG ATGCGGTCCT AACACCAGAA GGTGAAAAAG TTGTGACAGC AACTGGGATT
GGACTGAAAG ATGTTGCCTT TCAAAATGCA TATAGTAGTG ATAGTGGCCG CGCCTTGCAA
ACTGCTCAAC TTATTTTAGA TCAAAATAAA GCAGGCAAAG ACCTTGAAGT CGTGCGTGAC
CCAGATTTAC GTGAATTTAA TTTTGGTAGC TATGAAGGGG ATTTAAATAA GACAATGTGG
CAGGATATTG CTGATGATCA AGGTGTTTCC TTAGAAGAAT TTATGAAAAA CATGACTCCT
GAATCCTTTG CCAATAGTGT AGCTAAACTG GATCAACAGC GCGAGGAAAG CAAGAATAAC
TGGCCTGCAG AAGACTATGC TACAATTACT AAACGTTTGA AAAAGGCTT AGATAAAATT
GTTGCCACAG AATCAGCCAA TTCTGGGAAT GGCAATGTTT TAGTGGTCTC TCATGGCTTG
AGTATTTCAG CGTTGTTAGC AACTTTATTT GATGATTTTA AAGTCCCAGA AGGCGGTTTG
AAGAATGCTA GTGTCACAAC AATTCATTAC AAAAATGGCG AATATACTTT GGATAAAGTC
AATGATGTCA GCTACTTAGA AGCAGGCGAA AAAGAATCAA AA

EF005-4 (SEQ ID NO:20)
CGKNQQATT KEKETKPEEL TLYIVRHGKT MLNTTDRVQG
WSDAVLTPEG EKVVTATGIG LKDVAFQNAY SSDSGRALQT AQLILDQNKA GKDLEVVRDP
DLREFNFGSY EGDLNKTMWQ DIADDQGVSL EEFMKNMTPE SFANSVAKLD QQREESKNNW
PAEDYATITK RLKKGLDKIV ATESANSGNG NVLVVSHGLS ISALLATLFD DFKVPEGGLK
NASVTTIHYK NGEYTLDKVN DVSYLEAGEK ESK

EF006-1 (SEQ ID NO:21)
TAAACGATAA ATGGAGGGAA TAAGATGAAA AAACGTACAT TATGGTCAGT AATTACTGTA
GCAGTAGCTG TCTTAGTTTT AGGGGCTTGC GGCAATAAAA AGAGTGATGA CTCGGTCTTG
AAAGTTGGAG CTTCACCAGT TCCACATGCA GAGATTTTAG AACATGTAAA ACCTTTATTA
GAAAAAGAAG GCGTAAAATT AGAAGTGACG ACTTATACAG ATTACGTGCT ACCTAACAAG
GCGTTGGAAA GTGGCGATAT CGATGCCAAC TATTTCCAAC ATGTGCCGTT CTTTAATGAA
GCGGTTAAAG AAAATGATTA TGACTTTGTG AATGCAGGTG CGATTCATTT AGAACCAGTT
GGGCTTTACT CGAAAAAATA CAAATCGTTA CAAGAAATTC CTGATGGTTC AACGATTTAC
GTTAGCTCTT CCGTTTCAGA TTGGCCACGC GTATTAACTA TCTTAGAAGA TGCTGGTTTA
ATCACGCTGA AGAAGGGGT AGACCGGACA ACTGCTACTT CGATGATAT TGATAAAAAT
ACTAAAAAGT TGAAATTCAA TCATGAAAGT GATCCAGCAA TCATGACCAC TCTTTATGAC
AATGAAGAAG GGGCTGCGGT TTTAATTAAC TCAAACTTTG CCGTGGATCA AGGATTAAAT
CCGAAAAAAG ATGCGATTGC CTTAGAAAAA GAAAGTTCAC CTTATGCCAA TATTATTGCG
GTTCGTAAAG AAGACGAAAA CAACGAAAAT GTAAAAAAAT TAGTCAAAGT GTTACGTAGC
AAAGAAGTCC AAGATTGGAT TACGAAAAAA TGGAACGGCG CTATTGTTCC AGTCAATGAA
TAA

EF006-2 (SEQ ID NO:22)
MKK RTLWSVITVA VAVLVLGACG NKKSDDSVLK VGASPVPHAE ILEHVKPLLE
KEGVKLEVTT YTDYVLPNKA LESGDIDANY FQHVPFFNEA VKENDYDFVN AGAIHLEPVG
LYSKKYKSLQ EIPDGSTIYV SSSVSDWPRV LTILEDAGLI TLKEGVDRTT ATFDDIDKNT
KKLKFNHESD PAIMTTLYDN EEGAAVLINS NFAVDQGLNP KKDAIALEKE SSPYANIIAV
RKEDENNENV KKLVKVLRSK EVQDWITKKW NGAIVPVNE

EF006-3 (SEQ ID NO:23)
TTGC GGCAATAAAA AGAGTGATGA CTCGGTCTTG
AAAGTTGGAG CTTCACCAGT TCCACATGCA GAGATTTTAG AACATGTAAA ACCTTTATTA
GAAAAAGAAG GCGTAAAATT AGAAGTGACG ACTTATACAG ATTACGTGCT ACCTAACAAG
GCGTTGGAAA GTGGCGATAT CGATGCCAAC TATTTCCAAC ATGTGCCGTT CTTTAATGAA
GCGGTTAAAG AAAATGATTA TGACTTTGTG AATGCAGGTG CGATTCATTT AGAACCAGTT
GGGCTTTACT CGAAAAAATA CAAATCGTTA CAAGAAATTC CTGATGGTTC AACGATTTAC
GTTAGCTCTT CCGTTTCAGA TTGGCCACGC GTATTAACTA TCTTAGAAGA TGCTGGTTTA
ATCACGCTGA AGAAGGGGT AGACCGGACA ACTGCTACTT CGATGATAT TGATAAAAAT
ACTAAAAAGT TGAAATTCAA TCATGAAAGT GATCCAGCAA TCATGACCAC TCTTTATGAC
AATGAAGAAG GGGCTGCGGT TTTAATTAAC TCAAACTTTG CCGTGGATCA AGGATTAAAT
CCGAAAAAAG ATGCGATTGC CTTAGAAAAA GAAAGTTCAC CTTATGCCAA TATTATTGCG
GTTCGTAAAG AAGACGAAAA CAACGAAAAT GTAAAAAAAT TAGTCAAAGT GTTACGTAGC
AAAGAAGTCC AAGATTGGAT TACGAAAAAA TGGAACGGCG CTATTGTTCC AGTCAATGAA

EF006-4 (SEQ ID NO:24)
CG NKKSDDSVLK VGASPVPHAE ILEHVKPLLE
KEGVKLEVTT YTDYVLPNKA LESGDIDANY FQHVPFFNEA VKENDYDFVN AGAIHLEPVG
LYSKKYKSLQ EIPDGSTIYV SSSVSDWPRV LTILEDAGLI TLKEGVDRTT ATFDDIDKNT
KKLKFNHESD PAIMTTLYDN EEGAAVLINS NFAVDQGLNP KKDAIALEKE SSPYANIIAV
RKEDENNENV KKLVKVLRSK EVQDWITKKW NGAIVPVNE

EF008-1 (SEQ ID NO:25)
TAAACCGTGA GAAAGAAATG GAGGAATCAA CGAATGAAAA AATTTAGTTT ATTTTTTTTA
ACACTTTTAG CAGGGTTAAC GTTAGCTGCT TGCGGGAATC AAGCCGCTGA AAAGAAAGAA
AAATTAGCAA TTGTGACAAC GAACTCGATC CTATCTGATT TAGTGAAAAA TGTTGGGCAA
GACAAAATTG AGCTGCATAG TATTGTGCCA ATTGGGACAG ACCCTCACGA ATATGAACCG
TTACCAGAAG ACATTGCGAA AGCTTCTGAA GCGGACATTT TATTCTTTAA CGGCTTGAAC
TTAGAAACAG GCGGAAATGG CTGGTTTAAC AAATTAATGA AAACGCCAA AAAGTTGAG
AATAAAGATT ACTTTTCTAC AAGCAAAAAT GTTACGCCAC AATATTTAAC AAGTGCCGGT

TABLE 1-continued

Nucleotide and Amino Acid Seqeuences of E. faecalis Genes.

```
CAAGAACAAA CAGAAGATCC ACATGCTTGG TTAGACATTG AAAATGGCAT TAAATATGTA
GAAAACATTC GTGACGTGTT AGTAGAAAAA GATCCAAAAA ATAAAGATTT CTATACAGAA
AACGCGAAAA ATTATACCGA AAAACTTAGC AAACTACATG AGGAAGCCAA AGCTAAATTT
GCTGATATTC CTGATGATAA AAAATTATTA GTTACAAGTG AAGGTGCCTT TAAATATTTC
TCCAAAGCTT ATGATTTAAA TGCCGCTTAT ATTTGGGAAA TTAACACAGA AAGTCAAGGN
ACACCTGAAC AAATGACCAC GATTATTGAT ACCATTAAGA AATCAAAAGC ACCTGTGTTA
TTTGTTGAAA CCAGTGTCGA TAAACGTAGT ATGGAACGGG TCTCAAAAGA AGTGAAACGA
CCAATTTACG ATACACTTTT CACAGACTCT CTTGCCAAAG AAGGAACAGA AGGCGATACG
TACTACAGCA TGATGAACTG GAATTTAACA AAAATCCATG ATGGCTTAAT GAGTAAATAA
```

EF008-2 (SEQ ID NO:26)
MKKFSLFFLT LLAGLTLAAC GNQAAEKKEK LAIVTTNSIL SDLVKNVGQD
KIELHSIVPI GTDPHEYEPL PEDIAKASEA DILFFNGLNL ETGGNGWFNK LMKTAKKVEN
KDYFSTSKNV TPQYLTSAGQ EQTEDPHAWL DIENGIKYVE NIRDVLVEKD PKNKDFYTEN
AKNYTEKLSK LHEEAKAKFA DIPDDKKLLV TSEGAFKYFS KAYDLNAAYI WEINTESQGT
PEQMTTIIDT IKKSKAPVLF VETSVDKRSM ERVSKEVKRP IYDTLFTDSL AKEGTEGDTY
YSMMNWNLTK IHDGLMSK

EF008-3 (SEQ ID NO:27)
```
T TGCGGGAATC AAGCCGCTGA AAAGAAAGAA
AAATTAGCAA TTGTGACAAC GAACTCGATC CTATCTGATT TAGTGAAAAA TGTTGGGCAA
GACAAAATTG AGCTGCATAG TATTGTGCCA ATTGGGACAG ACCCTCACGA ATATGAACCG
TTACCAGAAG ACATTGCGAA AGCTTCTGAA GCGGACATTT TATTCTTTAA CGGCTTGAAC
TTAGAAACAG GCGGAAATGG CTGGTTTAAC AAATTAATGA AAACGGCCAA AAAAGTTGAG
AATAAAGATT ACTTTTCTAC AAGCAAAAAT GTTACGCCAA ATATTTAAC AAGTGCCGGT
CAAGAACAAA CAGAAGATCC ACATGCTTGG TTAGACATTG AAAATGGCAT TAAATATGTA
GAAAACATTC GTGACGTGTT AGTAGAAAAA GATCCAAAAA ATAAAGATTT CTATACAGAA
AACGCGAAAA ATTATACCGA AAAACTTAGC AAACTACATG AGGAAGCCAA AGCTAAATTT
GCTGATATTC CTGATGATAA AAAATTATTA GTTACAAGTG AAGGTGCCTT TAAATATTTC
TCCAAAGCTT ATGATTTAAA TGCCGCTTAT ATTTGGGAAA TTAACACAGA AAGTCAAGGN
ACACCTGAAC AAATGACCAC GATTATTGAT ACCATTAAGA AATCAAAAGC ACCTGTGTTA
TTTGTTGAAA CCAGTGTCGA TAAACGTAGT ATGGAACGGG TCTCAAAAGA AGTGAAACGA
CCAATTTACG ATACACTTTT CACAGACTCT CTTGCCAAAG AAGGAACAGA AGGCGATACG
TACTACAGCA TGATGAACTG GAATTTAACA AAAATCCATG ATGGCTTAAT GAGTAAA
```

EF008-4 (SEQ ID NO:28)
C GNQAAEKKEK LAIVTTNSIL SDLVKNVGQD
KIELHSIVPI GTDPHEYEPL PEDIAKASEA DILFFNGLNL ETGGNGWFNK LMKTAKKVEN
KDYFSTSKNV TPQYLTSAGQ EQTEDPHAWL DIENGIKYVE NIRDVLVEKD PKNKDFYTEN
AKNYTEKLSK LHEEAKAKFA DIPDDKKLLV TSEGAFKYFS KAYDLNAAYI WEINTESQGT
PEQMTTIIDT IKKSKAPVLF VETSVDKRSM ERVSKEVKRP IYDTLFTDSL AKEGTEGDTY
YSMMNWNLTK IHDGLMSK

EF009-1 (SEQ ID NO:29)
```
TGACAAATGA AAAATTTAG TAAATTAATT GGACTTATTG GGTATTAGC TTTTACGATT
GCAGGTTGTG CATCGGGGTC TGTGAAGGAT ACTAAGACAG AAACCGTTAA ACTAGGGGTT
GTAGGAACAA AAAATGATGA ATGGGAATCG GTCAAAGACC GTTTGAAAAA GAAAAATATT
GATTTACAAT TGGTAGAATT TACAGACTAT ACGCAACCAA ACGCAGCATT AGCAGAAAAA
GAAATTGATT TAAATGCCTT TCAGCATCAA ATCTTTTTAG ACAATTACAA TAAAGAGCAT
GGAACGAAAT TAGTATCAAT TGGCAATACA GTCAATGCAC CATTGGGAAT TTACGCTAAT
AAATTGAAAG ATATCACGAA AATTAAAGAC GGCGGAGAAA TTGCTATTCC TAATGACCCA
ACGAATGGCG GCGGGCGTT AATTTTATTA CAAACTGCAG GACTGATAAA AGTAGATCCT
GCGAAACAGC AACTACCGAC TGTCAGTGAT ATTACTGAAA ATAAACGCCA ATTGAAAATA
ACTGAATTAG ATGCTACGCA AACAGCGCGC GCTTTACAAG ATGTCGATGC TTCAGTGATT
AATAGCGGCA TGGCTGTCGA TGCTGGGTAT ACACCAGATA AAGATGCTAT TTTCTTAGAA
CCTGTAAACG AAAAAGCGAA ACCTTATGTG AACATTGTCG TGGCCCGAGA AGAAGATCAA
GAGAATAAAC TTTATCAAAA AGTTGTGAA GAATATCAAC AAGAAGAAAC GAAAAAGGTC
ATTGCAGAAA CATCAAAAGG CGCCAATGTT CCAGCCTGGG AAACATTTGG TAAAAAATAA
```

EF009-2 (SEQ ID NO:30)
MKKFSKLIG LIGVLAFTIA GCASGSVKDT KTETVKLGVV GTKNDEWESV KDRLKKKNTD
LQLVEFTDYT QPNAALAEKE IDLNAFQHQI FLDNYNKEHG TKLVSIGNTV NAPLGIYANK
LKDITKIKDG GEIAIPNDPT NGGRALILLQ TAGLIKVDPA KQQLPTVSDI TENKRQLKIT
ELDATQTARA LQDVDASVIN SGMAVDAGYT PDKDAIFLEP VNEKAKPYVN IVVAREEDQE
NKLYQKWEE YQQEETKKVI AETSKGANVP AWETFGKK

EF009-3 (SEQ ID NO:31)
```
TTGTG CATCGGGGTC TGTGAAGGAT ACTAAGACAG AAACCGTTAA ACTAGGGGTT
GTAGGAACAA AAAATGATGA ATGGGAATCG GTCAAAGACC GTTTGAAAAA GAAAAATATT
GATTTACAAT TGGTAGAATT TACAGACTAT ACGCAACCAA ACGCAGCATT AGCAGAAAAA
GAAATTGATT TAAATGCCTT TCAGCATCAA ATCTTTTTAG ACAATTACAA TAAAGAGCAT
GGAACGAAAT TAGTATCAAT TGGCAATACA GTCAATGCAC CATTGGGAAT TTACGCTAAT
AAATTGAAAG ATATCACGAA AATTAAAGAC GGCGGAGAAA TTGCTATTCC TAATGACCCA
ACGAATGGCG GCGGGCGTT AATTTTATTA CAAACTGCAG GACTGATAAA AGTAGATCCT
GCGAAACAGC AACTACCGAC TGTCAGTGAT ATTACTGAAA ATAAACGCCA ATTGAAAATA
ACTGAATTAG ATGCTACGCA AACAGCGCGC GCTTTACAAG ATGTCGATGC TTCAGTGATT
AATAGCGGCA TGGCTGTCGA TGCTGGGTAT ACACCAGATA AAGATGCTAT TTTCTTAGAA
```

TABLE 1-continued

Nucleotide and Amino Acid Seqeuences of E. faecalis Genes.

```
CCTGTAAACG AAAAAGCGAA ACCTTATGTG AACATTGTCG TGGCCCGAGA GAAGATCAA
GAGAATAAAC TTTATCAAAA AGTTGTAGAA GAATATCAAC AAGAAGAAAC GAAAAAGGTC
ATTGCAGAAA CATCAAAAGG CGCQAATGTT CCAGCCTGGG AAACATTTGG TAAAAAA

EF009-4 (SEQ ID NO:32)
CASGSVKDT KTETVKLGVV GTKNDEWESV KDRLKKKNID
LQLVEFTDYT QPNAALAEKE IDLNAFQHQI FLDNYNKEHG TKLVSIGNTV NAPLGIYANK
LKDITKIKDG GEIAIPNDPT NGGRALILLQ TAGLIKVDPA KQQLPTVSDI TENKRQLKIT
ELDATQTARA LQDVDASVIN SGMAVDAGYT PDKDAIFLEP VNEKAKPYVN IVVAREEDQE
NKLYQKVVEE YQQEETKKVI AETSKGANVP AWETFGKK

EF010-1 (SEQ ID NO:33)
TGAAAGAATA AAATTGTACA GGAGGAAATA AGGAATGAAA AAATGGCAAA AAGGATTAGC
CGTAGCTGGC GCACAGCTTT AGCTGTAGGA CTAAGCGCGT GCGGTAAATC TTCAAAAGAT
GCAGCGTCAA AAGGTGATGA TAGTACACCA ACGTTATTAA TGTATCGTGT TGGGGACAAA
CCAGATAATT ATGACCAATT AATCGATAAT GCGAATAAAA TTATCGAGAA AAAAATTGGG
GCAAAATTAA AAATGGAATT TGTTGGTTGG GGCGATTGGG ACCAAAAAAT GTCAACAATC
GTTGCTTCTG GTGAAAGCTA TGATATTTCA TTAGCACAAA ATTATGCAAC GAATGCACAA
AAAGGCGCCT ATGCTGATTT AACTGATTTA GCACCTAAAT ATGCCAAAGA AGCCTATGAT
CAATTGCCAG ATAACTATAT TAAAGGAAAT ACGATTAATG GAAACTGTA TGCGTTCCCA
ATTTTAGGTA ACTCTTACGG TCAACAAGTT TTAACTTTTA ATAAAGAATA TGTCGATAAA
TACAATTTAG ATATTAGTAA AGTCGATGGT AGTTATGAAA GTGCAACGGA AGTTCTAAAA
GAATTCCNTA AAAAANGANCC AAATATTGCT GCTTTTGCTA TCGGCCAAAC ATTCTTTGCA
ACAGGTAATT ATGACTTCCC TATTGGTAAC CAATATCCAT TGCAGTAAA AACAACTGAT
ACTGGCTCAC CAAAAATTAT TAACCAATAT GCCGACAAAG ACATGATTAA TAACTTAAAA
GTCTTGCATC AATGGTATAA AGATGGCTTG ATTCCAACAG ATGCTGCTAC AAGTACAACA
CCATATGACT TAAATACCAA TACTTGGTTT ATGCGTCAAG AAACACAAGG ACCTATGGAT
TATGGTGATA CAATCTTAAC ACAAGCTGCT GGCAAACCAC TTGTTTCTCG TCCACTAACA
GAACCATTAA AAACAACAGC TCAAGCGCAA ATGGCTAACT ATGTTGTTGC AAACACGTCT
AAAAACAAAG AAAAATCTGT TGAATTGTTA GGTTTATTAA ACAGCAATCC AGAATTGTTA
AACGGACTTG TTTATGGTGA AGAAGGCAAA CAATATGAAA AAGTTGGCGA TGATCGTGTG
AAATTGTTGA AGATTACAC ACCAACAACT CATTTGAGTG CTTGGAACAC AGGAAACAAC
TTAATCATTT GGCCAGAAGA ATCTGTCACT GAAGAAATGG TTAAAGAACG TGATAAGAGC
ATCGAAGAAG CAAAAGATTC ACCAATTCTT GGTTTTACTT TTGTAAATGA TAAAGTGAAA
ACTGAAATCA CTAACGTTGC TACAGTTATG AAQCGTTACG CAGCAAGCTT AAATACAGGA
ACTGTTGATC CAGAAGAAAC ACTTCCAAAA TTAATGGATG ACCTAAAAAC AGCTGGCTGG
GATAAAGTTC AAAAAGAAAT GCAAACACAA TTAGACGAAT ATATCCAATC TCAAAAATAA

EF010-2 (SEQ ID NO:34)
MAKRISR SWRTALAVGL SACGKSSKDA ASKGDDSTPT LLMYRVGDKP
DNYDQLIDNA NKIIEKKIGA KLKMEFVGWG DWDQKMSTIV ASGESYDISL AQNYATNAQK
GAYADLTDLA PKYAKEAYDQ LPDNYIKGNT INGKLYAFPI LGNSYGQQVL TFNKEYVDKY
NLDISKVDGS YESATEVLKE FXKXXPNIAA FAIGQTFFAT GNYDFPIGNQ YPFAVKTTDT
GSPKIINQYA DKDMINNLKV LHQWYKDGLI PTDAATSTTP YDLNTNTWFM RQETQGPMDY
GDTILTQAAG KPLVSRPLTE PLKTTAQAQM ANYVVANTSK NKEKSVELLG LLNSNPELLN
GLVYGEEGKQ YEKVGDDRVK LLKDYTPTTH LSAWNTGNNL IIWPEESVTE EMVKERDKSI
EEAKDSPILG FTFVNDKVKT EITNVATVMN RYAASLNTGT VDPEETLPKL MDDLKTAGWD
KVQKEMQTQL DEYIQSQK

EF010-3 (SEQ ID NO:35)
GT GCGGTAAATC TTCAAAAGAT
GCAGCGTCAA AAGGTGATGA TAGTACACCA ACGTTATTAA TGTATCGTGT TGGGGACAAA
CCAGATAATT ATGACCAATT AATCGATAAT GCGAATAAAA TTATCGAGAA AAAAATTGGG
GCAAAATTAA AAATGGAATT TGTTGGTTGG GGCGATTGGG ACCAAAAAAT GTCAACAATC
GTTGCTTCTG GTGAAAGCTA TGATATTTCA TTAGCACAAA ATTATGCAAC GAATGCACAA
AAAGGCGCCT ATGCTGATTT AACTGATTTA GCACCTAAAT ATGCCAAAGA AGCCTATGAT
CAATTGCCAG ATAACTATAT TAAAGGAAAT ACGATTAATG GAAACTGTA TGCGTTCCCA
ATTTTAGGTA ACTCTTACGG TCAACAAGTT TTAACTTTTA ATAAAGAATA TGTCGATAAA
TACAATTTAG ATATTAGTAA AGTCGATGGT AGTTATGAAA GTGCAACGGA AGTTCTAAAA
GAATTCCNTA AAAAANGANCC AAATATTGCT GCTTTTGCTA TCGGCCAAAC ATTCTTTGCA
ACAGGTAATT ATGACTTCCC TATTGGTAAC CAATATCCAT TGCAGTAAA AACAACTGAT
ACTGGCTCAC CAAAAATTAT TAACCAATAT GCCGACAAAG ACATGATTAA TAACTTAAAA
GTCTTGCATC AATGGTATAA AGATGGCTTG ATTCCAACAG ATGCTGCTAC AAGTACAACA
CCATATGACT TAAATACCAA TACTTGGTTT ATGCGTCAAG AAACACAAGG ACCTATGGAT
TATGGTGATA CAATCTTAAC ACAAGCTGCT GGCAAACCAC TTGTTTCTCG TCCACTAACA
GAACCATTAA AAACAACAGC TCAAGCGCAA ATGGCTAACT ATGTTGTTGC AAACACGTCT
AAAAACAAAG AAAAATCTGT TGAATTGTTA GGTTTATTAA ACAGCAATCC AGAATTGTTA
AACGGACTTG TTTATGGTGA AGAAGGCAAA CAATATGAAA AAGTTGGCGA TGATCGTGTG
AAATTGTTGA AGATTACAC ACCAACAACT CATTTGAGTG CTTGGAACAC AGGAAACAAC
TTAATCATTT GGCCAGAAGA ATCTGTCACT GAAGAAATGG TTAAAGAACG TGATAAGAGC
ATCGAAGAAG CAAAAGATTC ACCAATTCTT GGTTTTACTT TTGTAAATGA TAAAGTGAAA
ACTGAAATCA CTAACGTTGC TACAGTTATG AACCGTTACG CAGCAAGCTT AAATACAGGA
ACTGTTGATC CAGAAQAAAC ACTTCCAAAA TTAATGGATG ACCTAAAAAC AGCTGGCTGG
GATAAAGTTC AAAAAGAAAT GCAAACACAA TTAGACGAAT ATATCCAATC TCAAAAA

EF010-4 (SEQ ID NO:36)
CGKSSKDA ASKGDDSTPT LLMYRVGDKP
```

TABLE 1-continued

Nucleotide and Amino Acid Seqeuences of E. faecalis Genes.

DNYDQLIDNA NKIIEKKIGA KLKMEFVGWG DWDQKMSTIV ASGESYDISL AQNYATNAQK
GAYADLTDLA PKYAKEAYDQ LPDNYIKGNT INGKLYAFPI LGNSYGQQVL TFNKEYVDKY
NLDISKVDGS YESATEVLKE FXKXXPNIAA FAIGQTFFAT GNYDFPIGNQ YPFAVKTTDT
GSPKIINQYA DKDMINNLKV LHQWYKDGLI PTDAATSTTP YDLNTNTWFM RQETQGPMDY
GDTILTQAAG KPLVSRPLTE PLKTTAQAQM ANYVVANTSK NKEKSVELLG LLNSNPELLN
GLVYGEEGKQ YEKVGDDRVK LLKDYTPTTH LSAWNTGNNL IIWPEESVTE EMVKERDKSI
EEAKDSPILG FTFVNDKVKT EITNVATVMN RYAASLNTGT VDPEETLPKL MDDLKTAGWD
KVQKEMQTQL DEYIQSQK

EF011-1 (SEQ ID NO:37)
TAACGTTTTT GGAGGAAAAG AATGAAAAAG AAATTTTTAG CAATGATGGC AGTTTCAATG
ATGGGACTGT TAATGTTAAG TGCTTGTCAA ACAAATAAAA AAACAGCAGA TTCTGCAACA
ACAGAAACAA CAGCTAAAAC GGAAGTCACA GTCAAAGACA CCAATGGTCA ATTAACCGTT
CCCAAAAATC CTAAGAAAGT CGTTGTTTTT GATAATGGTT CCTTGGATAC AATGGATGCA
CTAGGTGTCG GTGACCGCGT GGTAGGTGCG CCAACTAAAA ATATCCCTGC GTATTTGAAA
AAATACCAAA AAGTTGAATC AGCAGGCGGC ATTAAAGAAC CAGATTTAGA AAAAATCAAT
CAACTAAAAC CAGACTTAAT TATTATTTCT GGTCGTCAAC AAGATTATCA AGAACAATTA
AAAGCCATTG CGCCAACCAT TTACTTAGCT GTAGATGCCA AAAATCCTTG GGCATCAACG
AAACAAAATA TCGAAACGTT AGGCACTATT TTTGATAAAG AAGAGGTAGC TAAAGAAAAA
ATAACTGGCT TAGAAAAAGA AATTGCTGAC GTGAAAAAAC AAGCAGAAGC TAGCGCGAAT
AATGCGCTTG TTGTGTTAGT TAACGAAGGA CAACTTTCCG CTTACGGAAA AGGCTCTCGT
TTCGGTTTAA TTCATGATAC ATTTGGCTTC AAAGCAGCAG ACGATAAGAT TGAAGCTTCC
ACTCATGGGC AAAGTGTTTC TTACGAATAT GTTTTAGAAA AAAATCCTGG GATTCTCTTT
GTGGTAGATC GCACCAAAGC AATTGGTGGC GACGATTCAA AAGATAACGT CGCTGCAAAC
GAATTGATTC AAAAAACCGA TGCTGGTAAA AATGATAAAG TCATTATGCT TCAACCAGAT
GTTTGGTATC TAAGCGGTGG TGGATTAGAA TCAATGCATT TGATGATAGA AGATGTTAAA
AAAGGATTAG AGTAA

EF011-2 (SEQ ID NO:38)
MKKK FLAMMAVSMM GLLMLSACQT NKKTADSATT ETTAKTEVTV KDTNGQLTVP
KNPKKVVVFD NGSLDTMDAL GVGDRVVGAP TKNIPAYLKK YQKVESAGGI KEPDLEKINQ
LKPDLIIISG RQQDYQEQLK AIAPTIYLAV DAKNPWASTK QNIETLGTIF DKEEVAKEKI
TGLEKEIADV KKQAEASANN ALVVLVNEGQ LSAYGKGSRF GLIHDTFGFK AADDKIEAST
HGQSVSYEYV LEKNPGILFV VDRTKAIGGD DSKDNVAANE LIQKTDAGKN DKVIMLQPDV
WYLSGGGLES MHLMIEDVKK GLE

EF011-3 (SEQ ID NO:39)
TTGTCAA ACAAATAAAA AAACAGCAGA TTCTGCAACA
ACAGAAACAA CAGCTAAAAC GGAAGTCACA GTCAAAGACA CCAATGGTCA ATTAACCGTT
CCCAAAAATC CTAAGAAAGT CGTTGTTTTT GATAATGGTT CCTTGGATAC AATGGATGCA
CTAGGTGTCG GTGACCGCGT GGTAGGTGCG CCAACTAAAA ATATCCCTGC GTATTTGAAA
AAATACCAAA AAGTTGAATC AGCAGGCGGC ATTAAAGAAC CAGATTTAGA AAAAATCAAT
CAACTAAAAC CAGACTTAAT TATTATTTCT GGTCGTCAAC AAGATTATCA AGAACAATTA
AAAGCCATTG CGCCAACCAT TTACTTAGCT GTAGATGCCA AAAATCCTTG GGCATCAACG
AAACAAAATA TCGAAACGTT AGGCACTATT TTTGATAAAG AAGAGGTAGC TAAAGAAAAA
ATAACTGGCT TAGAAAAAGA AATTGCTGAC GTGAAAAAAC AAGCAGAAGC TAGCGCGAAT
AATGCGCTTG TTGTGTTAGT TAACGAAGGA CAACTTTCCG CTTACGGAAA AGGCTCTCGT
TTCGGTTTAA TTCATGATAC ATTTGGCTTC AAAGCAGCAG ACGATAAGAT TGAAGCTTCC
ACTCATGGGC AAAGTGTTTC TTACGAATAT GTTTTAGAAA AAAATCCTGG GATTCTCTTT
GTGGTAGATC GCACCAAAGC AATTGGTGGC GACGATTCAA AAGATAACGT CGCTGCAAAC
GAATTGATTC AAAAAACCGA TGCTGGTAAA AATGATAAAG TCATTATGCT TCAACCAGAT
GTTTGGTATC TAAGCGGTGG TGGATTAGAA TCAATGCATT TGATGATAGA AGATGTTAAA
AAAGGATTAG AG

EF011-4 (SEQ ID NO:40)
CQT NKKTADSATT ETTAKTEVTV KDTNGQLTVP
KNPKKVVVFD NGSLDTMDAL GVGDRVVGAP TKNIPAYLKK YQKVESAGGI KEPDLEKINQ
LKPDLIIISG RQQDYQEQLK AIAPTIYLAV DAKNPWASTK QNIETLGTIF DKEEVAKEKI
TGLEKEIADV KKQAEASANN ALVVLVNEGQ LSAYGKGSRF GLIHDTFGFK AADDKIEAST
HGQSVSYEYV LEKNPGILFV VDRTKAIGGD DSKDNVAANE LIQKTDAGKN DKVIMLQPDV
WYLSGGGLES MHLMIEDVKK GLE

EF012-1 (SEQ ID NO:41)
TGAGGGGCA ACAACATGAA ATTGGGAAA AAAGTAGTAG GTTTGATTGC AACAGGGTTT
CTTTTAGCCG CATGTGGCGG AACCAAAGAA GCGGCAGAGA AAGTAGATTC GGGAAATTTA
GCAGCTGAAC AAAAAATCAG TATTAGTTCA CCTGCACCAA TCTCAACATT GGATACAACA
CAAACAACAG ATAAAAATAC CTTTACAATG GCACAACATT TATTTGAAGG CCTTTATCGG
TTTGATGATG ATAGTGCCAC GGTGCCAGCT CTAGCTAAAA ATGTCAAGAT TAGTGACGAT
GGGCGCAAGT ACCACTTTAC CTTGCGGGAG GGGATTAAGT GGAGCAACGG CGAGCCAATC
ACGGCCCAAG ATTTTGTTTA TTCTTGGAAA AAACTGGTGA CACCAGCGAC GATTGGACCG
AATGCCTATT TACTAGACAG TGTTAAAAAT AGTTTTGAAA TACGCAACGG TGAAAAGTCA
GTCGATGAAP TAGGGATTTC AGCCCCGAAT GACAAACAAT TCATTGTTGA ATTAAAACAG
GCCCAACCTT CCTTCTTAGC AGTCGTTTCG ATTGCTTGGT TAGCGCCACA AAATCAAAAA
TTTGTCGAAG CGCAAGGCAA AGATTACGCC TTGGATAGTG AACATTTACT TTATAGCGGG
CCATTTACGC TAGCCAATTG GGATGCGACT TCAGATACTT GGACATTGAA AAAAAATCCA
GAATACTATG ATGCGGATCA AGTGAAACTG GAAGAAGTTA CGGTTAGCAC AATCAAAGAA
GATAATACTG GGATTAACTT ATATCAAGTG AATGAACTAG ACTTAGTTCG CATTAACGGA

TABLE 1-continued

Nucleotide and Amino Acid Seqeuences of E. faecalis Genes.

```
CAATATGTTC AACAATATCA AGATGATCCA GGCTATGTCA GTCATCCAGA TGTGGCCAAC
TACTTCTTAG ATTTCAACAA AAAAGAAGGA ACGCCATTAG CGAATGTTCA TTTACGAAAA
GCGATTGGCC AAGCAATTGA TAAAGAAGCC TTAACACAAA GTGTCTTAAA CGATGGGTCA
AAACCCCTTA ACGGATTGAT TCCAAGTAAA CTTTATGCGA ATCCAGAAAC GGATGAAGAT
TTCCGAGCTT ACAGTGGCGA ATATTTGAAA AATGACGTCA AAAAAGCTCA AGCTGAATGG
ACGAAAGCCC AAGCGGATGT CGGTAAAAAA GTGAAACTTT CATTGCTGGC GGCAGACACA
GATCAAGGAA AACGAATTGC TGAATATGTT CAAAGTCAGT TGCAAGAAAA TCTGCCAGGT
TTAGAAATTA CCATTTCATC GCAACCAAGT AATAATGTGA ACCAATCGCG ACGTGAAAAA
AATTATGAGT TGTCTCTTTC AGGATGGATT GCCGGCAGTA GTGAATTAGA CTCTTACTTT
AACTTATATG CAGGAGAATC AAGTTACAAT TACGGCAATT ATCATAATGC CAAATACGAC
CAATTGGTAG AAGAGGCACG AACGATTAAT GCCAATAATC CAGAGAAACA GTTTGCAGAA
TACAAAGAAG CGGAAGACAT CTTGTTAAAC CAAGATGCTG CCCAAGTACC GCTGTATCAA
AGTGCCTCAA ATTATCTAAT CAATCCTAAA TTGAAAGGCA TTAGTTATCA CTTGTATGGG
GATTATTTCC ACTTGCGCAA TGCCTATTTA ACAGAATGA

EF012-2 (SEQ ID NO:42)
MKLGKK WGLIATGFL LAACGGTKEA AEKVDSGNLA AEQKISISSP APISTLDTTQ
TTDKNTFTMA QHLFEGLYRF DDDSATVPAL AKDVKISDDG RKYHFTLREG IKWSNGEPIT
AQDFVYSWKK LVTPATIGPN AYLLDSVKNS FEIRNGEKSV DELGISAPND KEFIVELKQA
QPSFLAVVSI AWLAPQNQKF VEAQGKDYAL DSEHLLYSGP FTLANWDATS DTWTLKKNPE
YYDADQVKLE EVAVSTIKED NTGINLYQVN ELDLVRINGQ YVQQYQDDPG YVSHPDVANY
FLDFNKKEGT PLANVHLRKA IGQAIDKEAL TQSVLNDGSK PLNGLIPSKL YANPETDEF
RAYSGEYLKN DVKKAQAEWT KAQADVGKKV KLSLLAADTD QGKRIAEYVQ SQLQENLPGL
EITISSQPSN NVNQSRREKN YELSLSGWIA GSSELDSYFN LYAGESSYNY GNYHNAKYDQ
LVEEARTINA NNPEKQFAEY KEAEDILLNQ DAAQVPLYQS ASNYLINPKL KGISYHLYGD
YFHLRNAYLT E

EF012-3 (SEQ ID NO:43)
ATGTGGCGG AACCAAAGAA GCGGCAGAGA AAGTAGATTC GGGAAATTTA
GCAGCTGAAC AAAAAATCAG TATTAGTTCA CCTGCAACAA TCTCAACATT GGATACAACA
CAAACAACAG ATAAAAATAC CTTTACAATG GCACAACATT TATTTGAAGG CCTTTATCGG
TTTGATGATG ATAGTGCCAC GGTGCCAGCT CTAGCTAAAG ATGTCAAGAT TAGTGACGAT
GGGCGCAAGT ACCACTTTAC CTTGCGGGAG GGGATTAAGT GGAGCAACGG CGAGCCAATC
ACGGCCCAAG ATTTTGTTTA TTCTTGGAAA AAACTGGTGA CACCAGCGAC GATTGGACCG
AATGCCTATT TACTAGACAG TGTTAAAAAT AGTTTTGAAA TACGCAACGG TGAAAAGTCA
GTCGATGAAT TAGGGATTTC AGCCCCGAAT GACAAAGAAT TCATTGTTGA ATTAAAACAG
GCCCAACCTT CCTTCTTAGC AGTCGTTTCG ATTGCTTGGT TAGCGCCACA AAATCAAAAA
TTTGTCGAAG CGCAAGGCAA AGATTACGCC TTGGATAGTG AACATTTACT TTATAGCGGG
CCATTTACGC TAGCCAATTG GGATGCGACT TCAGATACTT GGACATTGAA AAAAAATCCA
GAATACTATG ATGCGGATCA AGTGAAACTG AAGGAAGTTG CGGTTAGCAC AATCAAAGAA
GATAATACTG GGATTAACTT ATATCAAGTG AATGAACTAG ACTTAGTTCG CATTAACGGA
CAATATGTTC AACAATATCA AGATGATCCA GGCTATGTCA GTCATCCAGA TGTGGCCAAC
TACTTCTTAG ATTTCAACAA AAAAGAAGGA ACGCCATTAG CGAATGTTCA TTTACGAAAA
GCGATTGGCC AAGCAATTGA TAAAGAAGCC TTAACACAAA GTGTCTTAAA CGATGGGTCA
AAACCCCTTA ACGGATTGAT TCCAAGTAAA CTTTATGCGA ATCCAGAAAC GGATGAAGAT
TTCCGAGCTT ACAGTGGCGA ATATTTGAAA AATGACGTCA AAAAAGCTCA AGCTGAATGG
ACGAAAGCCC AAGCGGATGT CGGTAAAAAA GTGAAACTTT CATTGCTGGC GGCAGACACA
GATCAAGGAA AACGAATTGC TGAATATGTT CAAAGTCAGT TGCAAGAAAA TCTGCCAGGT
TTAGAAATTA CCATTTCATC GCAACCAAGT AATAATGTGA ACCAATCGCG ACGTGAAAAA
AATTATGAGT TGTCTCTTTC AGGATGGATT GCCGGCAGTA GTGAATTAGA CTCTTACTTT
AACTTATATG CAGGAGAATC AAGTTACAAT TACGGCAATT ATCATAATGC CAAATACGAC
CAATTGGTAG AAGAGGCACG AACGATTAAT GCCAATAATC CAGAGAAACA GTTTGCAGAA
TACAAAGAAG CGGAAGACAT CTTGTTAAAC CAAGATGCTG CCCAAGTACC GCTGTATCAA
AGTGCCTCAA ATTATCTAAT CAATCCTAAA TTGAAAGGCA TTAGTTATCA CTTGTATGGG
GATTATTTCC ACTTGCGCAA TGCCTATTTA ACAGAA

EF012-4 (SEQ ID NO:44)
CGGTKEA AEKVDSGNLA AEQKISISSP APISTLDTTQ
TTDKNTFTMA QHLFEGLYRF DDDSATVPAL AKDVKISDDG RKYHFTLREG KWSNGEPIT
AQDFVYSWKK LVTPATIGPN AYLLDSVKNS FEIRNGEKSV DELGISAPND KEFIVELKQA
QPSFLAVVSI AWLAPQNQKF VEAQGKDYAL DSEHLLYSGP FTLANWDATS DTWTLKKNPE
YYDADQVKLE EVAVSTIKED NTGINLYQVN ELDLVRINGQ YVQQYQDDPG YVSHPDVANY
FLDFNKKEGT PLANVHLRKA IGQAIDKEAL TQSVLNDGSK PLNGLIPSKL YANPETDEF
RAYSGEYLKN DVKKAQAEWT KAQADVGKKV KLSLLAADTD QGKRIAEYVQ SQLQENLPGL
EITISSQPSN NVNQSRREKN YELSLSGWIA GSSELDSYFN LYAGESSYNY GNYHNAKYDQ
LVEEARTINA NNPEKQFAEY KEAEDILLNQ DAAQVPLYQS ASNYLINPKL KGISYHLYGD
YFHLRNAYLT E

EF013-1 (SEQ ID NO:45)
TAACGAAAAA TGAAAAAAAT TGCTTTGTTC AGTATGTTAA CGTTCAGTGT ATTGTCTTTA
AGTCTAGCAG GATGTGGAAA CAAAAAAACA GCAAGCACAA ATGATTCTAA GCCAAAGCAA
GAAACAAAGA AAGCCACGCA GAAATCCTCT AGCCAACAAG AAATGAAAAG TAGTCATTCG
TCTGTCACGG GTCAAAATTC TAATGTGACA GGGGAAAATC CGTCAGAAAA TGCCACGCAG
CCTTCTGCAG GAACTGATGA AACGAATGAA GTCCCTCAAA ACCAAGCACC TGATACAAAC
ATTACAATTA CCAATGTTGT TTTCAATCCT GAAAGAAATG AAATTAATGG TACTACATTA
CCTAATGCAA CCATTACAGC AACGGTAGTC GGTGATGCTT CTGCACACAA AGGTGTTTTT
TATGCGGATG CCAATGGCAA TTTTACAGTA ATTAGTCCCA GAGCGGGAGC GACTACTCAA
```

TABLE 1-continued

Nucleotide and Amino Acid Seqeuences of E. faecalis Genes.

```
TTAATCGCAA CCGTTGATCA ACGGAATAGT GCACCTGTCC AAATTGATAT TCCAAGTTCA
GGACAAGAAG CAGCGCTTTC TTTTAGCAAT ATTACGATTG ATCCGAAACA AGGGACAATT
TCTGGTAAAA CAGCACCGAA TGCAACTATT TTAGTGTCAC GTGCAGATGA TGCGCGGGTG
ATTTTAGCAA GTTTTACTGC GGATGCCCAA GGGAATTTCA CAGCCAGTAA TTTAGTTCCC
GGCACAAAAA ATCGCTTAGA TGTTACGTTA AATGGAGAAA TAGGGACACC TTACTTGTTT
GATTTACCAA ATTAA
```

EF013-2 (SEQ ID NO:46)
```
MKKIALFS MLTFSVLSLS LAGCGNKKTA STNDSKPKQE TKKATQKSSS QQEMKSSHSS
VTGQNSNVTG ENPSENATQP SAGTDETNEV PQNQAPDTNI TITNWFNPE RNEINGTTLP
NATITATVVG DASAQAGVFY ADANGNFTVI SPRAGATTQL IATVDQRNSA PVQIDIPSSG
QEAALSFSNI TIDPKQGTIS GKTAPNATIL VSRADDARVI LASFTADAQG NFTASNLVPG
TKNRLDVTLN GEIGTPYLFD LPN
```

EF013-3 (SEQ ID NO:47)
```
ATGTGGAAA CAAAAAAACA GCAAGCACAA ATGATTCTAA GCCAAAGCAA
GAAACAAAGA AAGCCACGCA GAAATCCTCT AGCCAACAAG AAATGAAAAG TAGTCATTCG
TCTGTCACGG GTCAAAATTC TAATGTGACA GGGGAAAATC CGTCAGAAAA TGCCACGCAG
CCTTCTGCAG GAACTGATGA AACGAATGAA GTCCCTCAAA ACCAAGCACC TGATACAAAC
ATTACAATTA CCAATGTTGT TTTCAATCCT GAAAGAAATG AAATTAATGG TACTACATTA
CCTAATGCAA CCATTACAGC AACGGTAGTC GGTGATGCTT CTGCACAAGC AGGTGTTTTT
TATGCGGATG CCAATGGCAA TTTTACAGTA ATTAGTCCCA GAGCGGGAGC GACTACTCAA
TTAATCGCAA CCGTTGATCA ACGGAATAGT GCACCTGTCC AAATTGATAT TCCAAGTTCA
GGACAAGAAG CAGCGCTTTC TTTTAGCAAT ATTACGATTG ATCCGAAACA AGGGACAATT
TCTGGTAAAA CAGCACCGAA TGCAACTATT TTAGTGTCAC GTGCAGATGA TGCGCGGGTG
ATTTTAGCAA GTTTTACTGC GGATGCCCAA GGGAATTTCA CAGCCAGTAA TTTAGTTCCC
GGCACAAAAA ATCGCTTAGA TGTTACGTTA AATGGAGAAA TAGGGACACC TTACTTGTTT
GATTTACCAA AT
```

EF013-4 (SEQ ID NO:48)
```
CGNKKTA STNDSKPKQE TKKATQKSSS QQEMKSSHSS
VTGQNSNVTG ENPSENATQP SAGTDETNEV PQNQAPDTNI TITNVVFNPE RNEINGTTLP
NATITATVVG DASAQAGVFY ADANGNFTVI SPRAGATTQL IATVDQRNSA PVQIDIPSSG
QEAALSFSNI TIDPKQGTIS GKTAPNATIL VSRADDARVI LASFTADAQG NFTASNLVPG
TKNRLDVTLN GEIGTPYLFD LPN
```

EF014-1 (SEQ ID NO:49)
```
TGATGGTGGA GACTTTTTAA GAGAGAGGAA GTACAGCCAA TGAGTAGGAA GCGAAAAATC
AGCTTAATTA GTTTAGTCAT CATTTTGGTT TTTGTCACAG TCGGCTCAGC ATACTTTGCT
GTAGCGGGTA GCTATTTAAA GAAAACAATT GATAAAGGCT ATGTTCCCAT AAAAAATGAT
TATAATGAAG CGCAAAATAA AGATAGTCAA TCGTTTTTGA TTATGGGGCT AGACAATACA
ATTGAACGGA AATTAGGCAC AACTAGGACT GATGCTATGA TGGTGATTAC CGTGAATAAC
AAGACGAAGA AAATAACCTA TTTAAGTTTG CCACGGGATA GTTTTGTTCA AATTGATGCG
AAAAAATTACC AAGGGATGCA GCGAATTGAA GCCGCCTATA CCTACGATGG ACCAACAGCT
TCTGTTAACA CAGTTGAGAA ATTATTGAAT ATTCCAATCA ATCATTACGT TGTGTTTAAC
TTTTTATCTT TTATTAAGTT AATTGATGCG GTTGGCGGCA TAGATGTCAA TGTCAAGCAG
GCGTTTGATG GTGTCACCAA AGACGGGCCA GGATCCATTC ATTTTGATGC AGGGAAACAG
CATTTAGATG GTACGAAAGC TTTATCTTAT GCCCGTGAAA GACATAGCGA TAACGATATT
ATGCGTGGAT TCCGACAACA AGAAATTATT CAAGCAGTTG AAGACAAGTT GAAATCTGGT
CAATCAATCA TGAAAATAAT GGACATTATT GATTCGTTAA ATGGAAACAT TCAAACTGAT
GTGGATTCCA ATGAATTGAC TCATTTAGTC AAAGAAGGTT TGACTTGGAC CAATTATGAT
AAACAACAGC TTTCTTTTGA CTGGCGCACT TTTAGTAATG AAGGGCGCAG TATGGTTGAA
CTATACCCAG ATAGTATTGA AAATGTCCGT CATCAATTAC GTGTGTCTTT AAATTTAGAA
AAGCCAGATG AACGAGATCA AGACGGCTAT GTCTTCCATA CGAACGGTGA ATTTTTATAT
CAAAGTGATT ATACCGTTCA AGATGAAGCA GCTGAGGAAA ACGAAATGAC TTCCATCAAC
GGCAATACGT ATATTGGTGT TCCTGGTAAT ACACAGACCG GCCCGTTGCC ATCAGTTAAA
ACGGAAAATG GCTTTATAAA ATAA
```

EF014-2 (SEQ ID NO:50)
```
MSRKRKIS LISLVIILVF VTVGSAYFAV AGSYLKKTID KGYVPIKNDY
NEAQNKDSQS FLIMGLDNTI ERKLGTTRTD AMMVITVNNK TKKITYLSLP RDSFVQIDAK
NYQGMQRIEA AYTYDGPTAS VNTVEKLLNI PINHYVVFNF LSFIKLIDAV GGIDVNVKQA
FDGVTKDGPG SIHFDAGKQH LDGTKALSYA RERHSDNDIM RGFRQQEIIQ AVEDKLKSGQ
SIMKIMDIID SLNGNIQTDV DSNELTHLVK EGLTWTNYDK QQLSFDWRTF SNEGRSMVEL
YPDSIENVRH QLRVSLNLEK PDERDQDGYV FHTNGEFLYQ SDYTVQDEAA EENEMTSING
NTYIGVPGNT QTGPLPSVKT ENGFIK
```

EF014-3 (SEQ ID NO:51)
```
TGCT
GTAGCGGGTA GCTATTTAAA GAAAACAATT GATAAAGGCT ATGTTCCCAT AAAAAATGAT
TATAATGAAG CGCAAAATAA AGATAGTCAA TCGTTTTTGA TTATGGGGCT AGACAATACA
ATTGAACGGA AATTAGGCAC AACTAGGACT GATGCTATGA TGGTGATTAC CGTGAATAAC
AAGACGAAGA AAATAACCTA TTTAAGTTTG CCACGGGATA GTTTTGTTCA AATTGATGCG
AAAAAATTACC AAGGGATGCA GCGAATTGAA GCCGCCTATA CCTACGATGG ACCAACAGCT
TCTGTTAACA CAGTTGAGAA ATTATTGAAT ATTCCAATCA ATCATTACGT TGTGTTTAAC
TTTTTATCTT TTATTAAGTT AATTGATGCG GTTGGCGGCA TAGATGTCAA TGTCAAGCAG
GCGTTTGATG GTGTCACCAA AGACGGGCCA GGATCCATTC ATTTTGATGC AGGGAAACAG
```

TABLE 1-continued

Nucleotide and Amino Acid Seqeuences of *E. faecalis* Genes.

```
CATTTAGATG GTACGAAAGC TTTATCTTAT GCCCGTGAAA GACATAGCGA TAACGATATT
ATGCGTGGAT TCCGACAACA AGAAATTATT CAAGCAGTTG AAGACAAGTT GAAATCTGGT
CAATCAATCA TGAAAATAAT GGACATTATT GATTCGTTAA ATGGAAACAT TCAAACTGAT
GTGGATTCCA ATGAATTGAC TCATTTAGTC AAAGAAGGTT TGACTTGGAC CAATTATGAT
AAACAACAGC TTTCTTTTGA CTGGCGCACT TTTAGTAATG AAGGGCGCAA TATGGTTGAA
CTATACCCAG ATAGTATTGA AAATGTCCGT CATCAATTAC GTGTGTCTTT AAATTTAGAA
AAGCCAGATG AACGAGATCA AGACGGCTAT GTCTTCCATA CGAACGGTGA ATTTTTATAT
CAAAGTGATT ATACCGTTCA AGATGAAGCA GCTGAGGAAA ACGAAATGAC TTCCATCAAC
GGCAATACGT ATATTGGTGT TCCTGGTAAT ACACAGACCG GCCCGTTGCC ATCAGTTAAA
ACGGAAAATG GCTTTATAAA A

EF014-4 (SEQ ID NO:52)
AV AGSYLKKTID KGYVPIKNDY
NEAQNKDSQS FLIMGLDNTI ERKLGTTRTD AMMVITVNNK TKKITYLSLP RDSFVQIDAK
NYQGMQRIEA AYTYDGPTAS VNTVEKLLNI PINHYVVFNF LSFIKLIDAV GGIDVNVKQA
FDGVTKDGPG SIHFDAGKQH LDGTKALSYA RERHSDNDIM RGFRQQEIIQ AVEDKLKSGQ
SIMKIMDIID SLNGNIQTDV DSNELTHLVK EGLTWTNYDK QQLSFDWRTF SNEGRSMVEL
YPDSIENVRH QLRVSLNLEK PDERDQDGYV FHTNGEFLYQ SDYTVQDEAA EENEMTSING
NTYIGVPGNT QTGPLPSVKT ENGFIK

EF015-1 (SEQ ID NO:53)
TAATTAAAAA TGTGTAAAAA GGGTCTGATG AAAAAAGGAG ACATAATAGT TATTATCTTT
TTAATAGCTA TCTCTTTTTC TCCATATTTT ATTTTTTTTC ACAATAATCC ATTTAACTCC
AAAAGTTTTG ACGACACTAA ATATGCTGTG GTCAAGATAG ATGGGAAAGA GATTGAGCGT
ATAAATTTAG ATGATTCAAA AGAATTTATC AAAACATATT ATCCATCAAA AGGGCAATAT
AATACTATAG AAGTTAAAAA TGGGCACGTT CGTGTAAAAA AAGATAATAG TCCAGATCAA
ATTGCGGTGA AACAGGATG GATATCAGAA CCAGGGCNAA CTAGTATCTG TATTCCTCAC
AGATTCATTT TAGAAATTGT TCAACAATAT TCTAAGGATT ATTATATTTA CTAA

EF015-2 (SEQ ID NO:54)
MK KGDIIVIIFL IAISFSPYFI FFHNNPFNSK SFDDTKYAVV KIDGKEIERI
NLDDSKEFIK TYYPSKGQYN TIEVKNGHVR VKKDNSPDQI AVKTGWISEP GXTSICIPHR
FILEIVQQYS KDYYIY

EF015-3 (SEQ ID NO:55)
CAATAATCC ATTTAACTCC
AAAAGTTTTG ACGACACTAA ATATGCTGTG GTCAAGATAG ATGGGAAAGA GATTGAGCGT
ATAAATTTAG ATGATTCAAA AGAATTTATC AAAACATATT ATCCATCAAA AGGGCAATAT
AATACTATAG AAGTTAAAAA TGGGCACGTT CGTGTAAAAA AAGATAATAG TCCAGATCAA
ATTGCGGTGA AACAGGATG GATATCAGAA CCAGGGCNAA CTAGTATCTG TATTCCTCAC
AGATTCATTT TAGAAATTGT TCAACAATAT TCTAAGGATT ATTATATTTA C

EF015-4 (SEQ ID NO:56)
NNPFNSK SFDDTKYAVV KIDGKEIERI
NLDDSKEFIK TYYPSKGQYN TIEVKNGHVR VKKDNSPDQI AVKTGWISEP GXTSICIPHR
FILEIVQQYS KDYYIY

EF016-1 (SEQ ID NO:57)
TGACGGTTGC CCCCGTCCAA TAGAAAGGAG TTTATGATGA AAAAGAAATA TTCTTTAGCC
TTGCTGGTTA TCTGTTGTAG TTTACTCCTA TTTGCAGGTT GTGGTAAAAG AAAAAGCAAC
GAAGATCAAT GGACACGGAT TAACGAAGAA AAACGGATTA TTATTGGCTT AGATGACTCC
TTTGTGCCCA TGGGTTTTCA AGATAAATCA GGCAAAATTG TCGGCTTTGA TGTCGACTTA
GCCAAAGCGG TTTTTAAACT TTATGGCATT TCCGTTGACT TCCAACCGAT TGATTGGTCT
ATGAAAGAAA CAGAATTACA AAATCAAACC ATTGATCTTA TTTGGAACGG CTACACTAAA
ACGAGCGAGC GGGCCGAAAA AGTTCAATTC ACACAACCTT ACATGACGAA CGACCAAGTA
CTTGTTTCTT TAAAAGAAAA AAACATTGCA ACAGCGAGCG ACATGCAAGG CAAAATTTTA
GGGGTTCAAA ACGGCTCTTC TGGCTATGAT GGCTTCGAAA GTCAGCCTGA CGTTTTGAAA
AAATTTGTTA AAGACCAAAC ACCTATTTTA TATGACGGCT TTAATGAAGC TTTCTTAGAT
TTAAAATCTG GTCGAATTGA CGGACTCCTA ATCGATCGTG TTTACGCCAA CTACTATCTT
TCCCACGAAG ATAATTTAAA AAACTATACT ATTTCTCATG TAGGCTATGA CAATGAAGAT
TTTGCTGTGG GCGTCCGCAA ATCAGACAAT CAATTAGTCC AAAAAATCAA TACTGCCTTT
GAAACGTTAC GAAAAGATGG CACCCTTAGT AAAATTTCTC AAAAATGGTT TGGAGAGGAC
GTTACAAATA ACACAAAAAT AAACTAA

EF016-2 (SEQ ID NO:58)
MMKKKYSLAL LVICCSLLLF AGCGKRKSNE DQWTRINEEK RIIIGLDDSF
VPMGFQDKSG KIVGFDVDLA KAVFKLYGIS VDFQPIDWSM KETELQNQTI DLIWNGYTKT
SERAEKVQFT QPYMTNDQVL VSLKEKNIAT ASDMQGKILG VQNGSSGYDG FESQPDVLKK
FVKDQTPILY DGFNEAFLDL KSGRIDGLLI DRVYANYYLS HEDNLKNYTI SHVGYDNEDF
AVGVRKSDNQ LVQKINTAFE TLRKDGTLSK ISQKWFGEDV TNNTKIN

EF016-3 (SEQ ID NO:59)
AAGCAAC
GAAGATCAAT GGACACGGAT TAACGAAGAA AAACGGATTA TTATTGGCTT AGATGACTCC
TTTGTGCCCA TGGGTTTTCA AGATAAATCA GGCAAAATTG TCGGCTTTGA TGTCGACTTA
GCCAAAGCGG TTTTTAAACT TTATGGCATT TCCGTTGACT TCCAACCGAT TGATTGGTCT
ATGAAAGAAA CAGAATTACA AAATCAAACC ATTGATCTTA TTTGGAACGG CTACACTAAA
```

TABLE 1-continued

Nucleotide and Amino Acid Seqeuences of E. faecalis Genes.

ACGAGCGAGC GGGCCGAAAA AGTTCAATTC ACACAACCTT ACATGACGAA CGACCAAGTA
CTTGTTTCTT TAAAAGAAAA AAACATTGCA ACAGCGAGCG ACATGCAAGG CAAAATTTTA
GGGGTTCAAA ACGGCTCTTC TGGCTATGAT GGCTTCGAAA GTCAGCCTGA CGTTTTGAAA
AAATTTGTTA AAGACCAAAC ACCTATTTTA TATGACGGCT TTAATGAAGC TTTCTTAGAT
TTAAAATCTG GTCGAATTGA CGGACTCCTA ATCGATCCGG TTTACGCCAA CTACTATCTT
TCCCACGAAG ATAATTTAAA AAACTATACT ATTTCTCATG TAGGCTATGA CAATGAAGAT
TTTGCTGTGG GCGTCCGCAA ATCAGACAAT CAATTAGTCC AAAAAATCAA TACTGCCTTT
GAAACGTTAC GAAAAGATGG CACCCTTAGT AAAATTTCTC AAAAATGGTT TGGAGAGGAC
GTTACAAATA ACACAAAAAT AAAC

EF016-4 (SEQ ID NO:60)
SNE DQWTRINEEK RIIIGLDDSF
VPMGFQDKSG KIVGFDVDLA KAVFKLYGIS VDFQPIDWSM KETELQNQTI DLIWNGYTKT
SERAEKVQFT QPYMTNDQVL VSLKEKNIAT ASDMQGKILG VQNGSSGYDG FESQPDVLKK
FVKDQTPILY DGFNEAFLDL KSGRIDGLLI DRVYANYYLS HEDNLKNYTI SHVGYDNEDF
AVGVRKSDNQ LVQKINTAFE TLRKDGTLSK ISQKWFGEDV TNNTKIN

EF017-1 (SEQ ID NO:61)
TGAGGTGTTT TTATGAAAAG GGCAACAAAG CAAAGGCTGT CTTTGGCAGC AATCATGGTT
CTACTTCTCT CGGGCTGTGG AAGTGTTGGG AAAGAAACCA AAAAGCAAGA ACAACAGGTA
TTACGGGTCG GGATTGATTC GGAATTATCA ACGGCAGACG TGTCGTTGGC AATGGATAAT
ACCGCAGCAG ATGTAATGAG CCAAGTAGGG GAGGGACTTT TCTCCTTTGA CGAAAAAGGA
GAAGCGAAAC CAGCATTGGC AACTGAAAAA GTACAGCCCT CCAATGATGG TTTAAGCTAT
ACTTTTACGA TTCGAAAAGA TGCAAAATGG AGTAACGGCG AGCCAATCAC AGCAAATGAT
TTTGAATACT CTTGGAAGCG CACAGTGGAC CCAAAAACAG CTTCCCCGCA AGCGTATTAC
TTTGAAGGGT TAAAAAATTA TCGTGCTATT GTTGACGGTA GCAAATCTAA AGAAGAGTTA
GGGGTAACAG CCATTGATGA CCATACCTTG GAAGTAGAGC TAAGCTATCC TATGAGTTAT
TTTCAACAAT TATTGGCGGT ACCAGCTTTT TATCCTTTAA ATGAAGCATT TGTCGAAAAA
ACGGGCAAAA ACTATGGTAC ATCAGCTGAG TCAACACTTT ACAATGGCGC CTTCACATTA
GAAGGTTGGG ATGGCACGAA TAATACTTGG TCCTATGTGA AGAATAAAAA TTATTGGGAT
CAAGCGAATG TTTCGCTAGA TAAGGTGGAT GTCCAAGTAG TTAAAGAAGT CAATACTGGG
AAAAAATCTTT TCGAAGGGAA AGAATTAGAT GTTGTAAAAA TTTCTGGAGA AATTGTTGCA
CAAGAACAAG GCAATGCAGC TTTGAAAATT CGTGAAATTC CTGGAACGTA TTATATCCAA
TTAAATACGC AAAAAGATCT TTTGGCAAAT AAGAATGCAC GTCGAGCAAT AGCATTATCA
TTGAATTCTG AGCGTTTAGC TAAAAATGTT TTAAATGATG GCTCAAAAAA AGCACTTGGC
TTCGTGCCAA CAGGTTTCAC TAATCAAGAA ACGCAAAAAG ATTTTGCAGA GGAATTAGGA
GATTTAAATC CTAGTGAACC AGAAAAAGCG AAAGAGTTAT GGCAAACGGC TAAAAAAGAA
TTAGGAATTG AAAAAGCGGA GCTAACGATT TTAAGTTCGG ATACAGAAAA TGCTAAAAAA
ATCAGTGAGT ATGTTCAAGG AGCTTTAGCA GATAATTTAG AAAATTTAAC AGTCAATGTT
TCACCAGTTC CTTTTAATAA TCGTTTAGAA AAAAGTCGCA GCGGAGATTT CGACATTGTG
GTTGGTGGCT GGACGCCAGT ATATGCTGAT CCAATCGATT TCTTAAACTT ACTGCAATCA
AAAAATTCCA ATAATTTTGG TAAATGGTCT AATAAGACT TTGATCAGTT GCTTCAAGAA
GCAAACGTAA CTTATGCAAA TAAATATGAA GAACGTTGGA AAACATTACA AAAAGCGGAT
CAATTGGTTG CGGAAGAAGC CCCCCTAGTT CCTCTTTATC AATTAACAGA AGCACGCTTA
GTGGCCGATT CTGTCCAAAA TTTAGTCTAT GGTCCATTAG GTTCAGGCTA TTACAAATCA
GTCTCTATCG GCGACAAGTA A

EF017-2 (SEQ ID NO:62)
MKRATKQ RLSLAAIMVL LLSGCGSVGK ETKKQEQQVL RVGIDSELST ADVSLAMDNT
AADVMSQVGE GLFSFDEKGE AKPALATEKV QPSNDGLSYT FTIRKDAKWS NGEPITANDF
EYSWKRTVDP KTASPQAYYF EGLKNYRAIV DGSKSKEELG VTAIDDHTLE VELSYPMSYF
QQLLAVPAFY PLNEAFVEKT GKNYGTSAES TLYNGAFTLE GWDGTNNTWS YVKNKNYWDQ
ANVSLDKVDV QVVKEVNTGK NLFEGKELDV VKISGEIVAQ EQGNAALKIR EIPGTYYIQL
NTQKDLLANK NARRAIALSL NSERLAKNVL NDGSKKALGF VPTGFTNQET QKDFAEELGD
LNPSEPEKAK ELWQTAKKEL GIEKAELTIL SSDTENAKKI SEYVQGALAD NLENLTVNVS
PVPFNNRLEK SRSGDFDIVV GGWTPVYADP IDFLNLLQSK NSNNFGKWSN KTFDQLLQEA
NVTYANKYEE RWKTLQKADQ LVAEEAPLVP LYQLTEARLV ADSVQNLVYG PLGSGYYKSV
SIGDK

EF017-3 (SEQ ID NO:63)
CTGTGG AAGTGTTGGG AAAGAAACCA AAAAGCAAGA ACAACAGGTA
TTACGGGTCG GGATTGATTC GGAATTATCA ACGGCAGACG TGTCGTTGGC AATGGATAAT
ACCGCAGCAG ATGTAATGAG CCAAGTAGGG GAGGGACTTT TCTCCTTTGA CGAAAAAGGA
GAAGCGAAAC CAGCATTGGC AACTGAAAAA GTACAGCCCT CCAATGATGG TTTAAGCTAT
ACTTTTACGA TTCGAAAAGA TGCAAAATGG AGTAACGGCG AGCCAATCAC AGCAAATGAT
TTTGAATACT CTTGGAAGCG CACAGTGGAC CCAAAAACAG CTTCCCCGCA AGCGTATTAC
TTTGAAGGGT TAAAAAATTA TCGTGCTATT GTTGACGGTA GCAAATCTAA AGAAGAGTTA
GGGGTAACAG CCATTGATGA CCATACCTTG GAAGTAGAGC TAAGCTATCC TATGAGTTAT
TTTCAACAAT TATTGGCGGT ACCAGCTTTT TATCCTTTAA ATGAAGCATT TGTCGAAAAA
ACGGGCAAAA ACTATGGTAC ATCAGCTGAG TCAACACTTT ACAATGGCGC CTTCACATTA
GAAGGTTGGG ATGGCACGAA TAATACTTGG TCCTATGTGA AGAATAAAAA TTATTGGGAT
CAAGCGAATG TTTCGCTAGA TAAGGTGGAT GTCCAAGTAG TTAAAGAAGT CAATACTGGG
AAAAAATCTTT TCGAAGGGAA AGAATTAGAT GTTGTAAAAA TTTCTGGAGA AATTGTTGCA
CAAGAACAAG GCAATGCAGC TTTGAAAATT CGTGAAATTC CTGGAACGTA TTATATCCAA
TTAAATACGC AAAAAGATCT TTTGGCAAAT AApAATGCAC GTCGAGCAAT AGCATTATCA
TTGAATTCTG AGCGTTTAGC TAAAAATGTT TTAAATGATG GCTCAAAAAA AGCACTTGGC
TTCGTGCCAA CAGGTTTCAC TAATCAAGAA ACGCAAAAAG ATTTTGCAGA GGAATTAGGA

TABLE 1-continued

Nucleotide and Amino Acid Seqeuences of E. faecalis Genes.

```
GATTTAAATC CTAGTGAACC AGAAAAAGCG AAAGAGTTAT GGCAAACGGC TAAAAAAGAA
TTAGGAATTG AAAAAGCGGA GCTAACGATT TTAAGTTCGG ATACAGAAAA TGCTAAAAAA
ATCAGTGAGT ATGTTCAAGG AGCTTTAGCA GATAATTTAG AAAATTTAAC AGTCAATGTT
TCACCAGTTC CTTTTAATAA TCGTTTAGAA AAAAGTCGCA GCGGAGATTT CGACATTGTG
GTTGGTGGCT GGACGCCAGT ATATGCTGAT CCAATCGATT TCTTAAACTT ACTGCAATCA
AAAAATTCCA ATAATTTTGG TAAATGGTCT AATAAGACCT TTGATCAGTT GCTTCAAGAA
GCAAACGTAA CTTATGCAAA TAAATATGAA GAACGTTGGA AACATTACA AAAAGCGGAT
CAATTGGTTG CGGAAGAAGC CCCCCTAGTT CCTCTTTATC AATTAACAGA AGCACGCTTA
GTGGCCGATT CTGTCCAAAA TTTAGTCTAT GGTCCATTAG GTTCAGGCTA TTACAAATCA
GTCTCTATCG GCGACAAG

EF017-4 (SEQ ID NO:64)
CGSVGK ETKKQEQQVL RVGIDSELST ADVSLAMDNT
AADVMSQVGE GLFSFDEKGE AKPALATEKV QPSNDGLSYT FTIRKDAKWS NGEPITANDF
EYSWKRTVDP KTASPQAYYF EGLKNYRAIV DGSKSKEELG VTAIDDHTLE VELSYPMSYF
QQLLAVPAFY PLNEAFVEKT GKNYGTSAES TLYNGAFTLE GWDGTNNTWS YVKNKNYWDQ
ANVSLDKVDV QVVKEVNTGK NLFEGKELDV VKISGEIVAQ EQGNAALKIR EIPGTYYIQL
NTQKDLLANK NARRAIALSL NSERLAKNVL NDGSKKALGF VPTGFTNQET QKDFAEELGD
LNPSEPEKAK ELWQTAKKEL GIEKAELTIL SSDTENAKKI SEYVQGALAD NLENLTVNVS
PVPFNNRLEK SRSGDFDIVV GGWTPVYADP IDFLNLLQSK NSNNFGKWSN KTFDQLLQEA
NVTYANKYEE RWKTLQKADQ LVAEEAPLVP LYQLTEARLV ADSVQNLVYG PLGSGYYKSV
SIGDK

EF018-1 (SEQ ID NO:65)
TGTCATTACA ACGATACCAA TTTTAATCAT TTATCCATTA CTACAAAAAC ACTTTATCGG
CGGTATGATG GCCGGTGCAG TAAAAGAATA AAGAAAGTAG GGAACAATAT GAAAAAAGTT
TTAGGCGGTT TATTGGTGGC AACGGCGGTC GTTAGTTTAG CGGCCTGTAG CGGTGGGGAA
AAGAAAGCTA GCTCAGATGT CTCAATTAAG GATCGGTATG AATTAGATGA AAAGACGCCT
GCTTGGAAGT TAGATAAGAA GAAAGAACCG ACCAAGATTA AATGGTATAT TAACTCAGAT
TGGACGGCGC TGCCTTTTGG AAAAGACGTG ACCACTGCGC AGATTAAAAA AGACTTAAAT
GTGGATATTG AATTTATTTC CGGCGATGAT TCAAAATTAA ATGCCATGAT TTCAAGTGGA
GATATGCCTG ATATCGTGAC ATTAACTGAA AAAACTGGAC AAGCAGCATT GAAAGCAGAT
TCTTGGGCCT ATTCTTTAAA CGATTTAGCT AAAAAATATG ACCCCTATTT AATGAAAGTT
GTTAACCAAG ATACGTTTAA ATGGTATGCC TTAGAGGATG GAAAAACATA TGGTTACCCT
AATTACTCTA ATACAAAAGC GGATTATGAA AGTGGAAATA TCCCAGTAAA TGATAATTTT
GTTATTCGTG AAGATGTCTA TAATGCATTA GGCAAGCCAG ACGTTCAAC ACCAGAAAAT
TTTGAAAAAG TCATGCAACA GATTAAAGAA AAATATCCTG AGATGACCCC AATGGGCTTC
ACCACAGTGG GCGATGGTGC AGGACCATTT TTAGACAAAT TACAAGACTT CTTAGGTGTT
CCTTTAGAGG ATAAAAATGG TAAATACTAT GATCGAAATT TAGATAAAGA ATATTTAGAA
TGGTTAAAAA CATTTAATGA TGTTTACCGA GCAGGCAATA TTAGTGATGA TAGCTTCACA
GATGATGGGG CAACGTTTGA TGAAAAAGTG AAACAAGGAA ATTATGCAAC CATGCTCGTT
GCTGGAACCA GTGGTCAAGG TGGGAACTTC ACAGAATTTA TGAAAAAATC TGGCACACGT
TATATAGCCA TTGATGGACC AAGTAGCACT TCTGGCCGAA AACCAACATT AAATCAAACC
GGCATTTCAG GTTGGTTAAG TAATTACATT ACGAAAGATG CGAAAGATCC AGCAAAAGTC
ACTCAACTGT TCACATATTT AATTGATGAA CCGGACAAA TTTTAACAAA ATATGGCGTT
GAAGGAGTTA CTTATGCGTA CAATGATCAA GGAAAAATTG ATTATTTACC AGAAGTGAAA
AAATTAGAAC AAACAGACAA TGATGCCTAC AACAAAAAAT ATGGCATTAG TCGTTTCCTA
TACTTTAACA ACGACCGTGT CAATAAACTA AAAGTACCAA TGGAAAGTGC TTTAACGCAA
ATGCAAGAAT GGGGCAAAGG AAAATTAGTC CCACATTTCG TAATTGAAAA TATTAATCCA
GATGCAGGAA CGCCGGAAGC TCGTGCGAAT GAAGCGATTG AAACCAAACT AAATACAACC
GTTATTTCAA TGATTCGTGC GAAAGATGAT AAAGCCTTTG ACAAATCTTT AGAAGACTAC
AAAGCATTCT TAAAATCAAA TAAATGGGAT GCAATTGAAA AAATAAAATC TGAGAAAATG
GCGGAAAACA GAGACAAACT TAAGTAA

EF018-2 (SEQ ID NO:66)
MKKV LGGLLVATAV VSLAACSGGE
KKASSDVSIK DRYELDEKTP AWKLDKKKEP TKIKWYINSD WTALPFGKDV TTAQIKKDLN
VDIEFISGDD SKLNAMISSG DMPDIVTLTE KTGQAALKAD SWAYSLNDLA KKYDPYLMKV
VNQDTFKWYA LEDGKTYGYP NYSNTKADYE SGNIPVDNF VIREDVYNAL GKPDVSTPEN
FEKVMQQIKE KYPEMTPMGF TTVGDGAGPF LDKLQDFLGV PLEDKNGKYY DRNLDKEYLE
WLKTFNDVYR AGNISDDSFT DDGATFDEKV KQGNYATMLV AGTSGQGGNF TEFMKKSGTR
YIAIDGPSST SGRKPTLNQT GISGWLSNYI TKDAKDPAKV TQLFTYLIDE PGQILTKYGV
EGVTYAYNDQ GKIDYLPEVK KLEQTDNDAY NKKYGISRFL YFNNDRVNKL KVPMESALTQ
MQEWGKGKLV PHFVIENINP DAGTPEARAN EAIETKLNTT VISMIRAKDD KAFDKSLEDY
KAFLKSNKWD AIEKIKSEKM AENRDKLK

EF018-3 (SEQ ID NO:67)
CTGTAG CGGTGGGGAA
AAGAAAGCTA GCTCAGATGT CTCAATTAAG GATCGGTATG AATTAGATGA AAAGACGCCT
GCTTGGAAGT TAGATAAGAA GAAAGAACCG ACCAAGATTA AATGGTATAT TAACTCAGAT
TGGACGGCGC TGCCTTTTGG AAAAGACGTG ACCACTGCGC AGATTAAAAA AGACTTAAAT
GTGGATATTG AATTTATTTC CGGCGATGAT TCAAAATTAA ATGCCATGAT TTCAAGTGGA
GATATGCCTG ATATCGTGAC ATTAACTGAA AAAACTGGAC AAGCAGCATT GAAAGCAGAT
TCTTGGGCCT ATTCTTTAAA CGATTTAGCT AAAAAATATG ACCCCTATTT AATGAAAGTT
GTTAACCAAG ATACGTTTAA ATGGTATGCC TTAGAGGATG GAAAAACATA TGGTTACCCT
AATTACTCTA ATACAAAAGC GGATTATGAA AGTGGAAATA TCCCAGTAAA TGATAATTTT
GTTATTCGTG AAGATGTCTA TAATGCATTA GGCAAGCCAG ACGTTCAAC ACCAGAAAAT
```

TABLE 1-continued

Nucleotide and Amino Acid Seqeuences of E. faecalis Genes.

```
TTTGAAAAAG TCATGCAACA GATTAAAGAA AAATATCCTG AGATGACCCC AATGGGCTTC
ACCACAGTGG GCGATGGTGC AGGACCATTT TTAGACAAAT TACAAGACTT CTTAGGTGTT
CCTTTAGAGG ATAAAAATGG TAAATACTAT GATCGAAATT TAGATAAAGA ATATTTAGAA
TGGTTAAAAA CATTTAATGA TGTTTACCGA GCAGGCAATA TTAGTGATGA TAGCTTCACA
GATGATGGGG CAACGTTTGA TGAAAAAGTG AAACAAGGAA ATTATGCAAC CATGCTCGTT
GCTGGAACCA GTGGTCAAGG TGGGAACTTC ACAGAATTTA TGAAAAAATC TGGCACACGT
TATATAGCCA TTGATGGACC AAGTAGCACT TCTGGCCGAA AACCAACATT AAATCAAACC
GGCATTTCAG GTTGGTTAAG TAATTACATT ACGAAAGATG CGAAAGATCC AGCAAAAGTC
ACTCAACTGT TCACATATTT AATTGATGAA CCGGGACAAA TTTTAACAAA ATATGGCGTT
GAAGGAGTTA CTTATGCGTA CAATGATCAA GGAAAAATTG ATTATTTACC AGAAGTGAAA
AAATTAGAAC AAACAGACAA TGATGCCTAC AACAAAAAAT ATGGCATTAG TCGTTTCCTA
TACTTTAACA ACGACCGTGT CAATAAACTA AAAGTACCAA TGGAAAGTGC TTTAACGCAA
ATGCAAGAAT GGGGCAAAGG AAAATTAGTC CCACATTTCG TAATTGAAAA TATTAATCCA
GATGCAGGAA CGCCGGAAGC TCGTGCCAAT GAAGCGATTG AAACCAAACT AAATACAACC
GTTATTTCAA TGATTCGTGC GAAAGATGAT AAAGCCTTTG ACAAATCTTT AGAAGACTAC
AAAGCATTCT TAAAATCAAA TAAATGGGAT QCAATTGAAA AATAAAATC TGAGAAAATG
GCGGAAAACA GAGACAAACT TAAG

EF018-4 (SEQ ID NO:68)
CSGGE
KKASSDVSIK DRYELDEKTP AWKLDKKKEP TKIKWYINSD WTALPFGKDV TTAQIKKDLN
VDIEFISGDD SKLNAMISSG DMPDIVTLTE KTGQAALKAD SWAYSLNDLA KKYDPYLMKV
VNQDTFKWYA LEDGKTYGYP NYSNTKADYE SGNIPVNDNF VIREDVYNAL GKPDVSTPEN
FEKVMQQIKE KYPEMTPMGF TTVGDGAGPF LDKLQDFLGV PLEDKNGKYY DRNLDKEYLE
WLKTFNDVYR AGNISDDSFT DDGATFDEKV KQGNYATMLV AGTSGQGGNF TEFMKKSGTR
YIAIDGPSST SGRKPTLNQT GISGWLSNYI TKDAKDPAKV TQLFTYLIDE PGQILTKYGV
EGVTYAYNDQ GKIDYLPEVK KLEQTDNDAY NKKYGISRFL YFNNDRVNKL KVPMESALTQ
MQEWGKGKLV PHFVIENINP DAGTPEARAN EAIETKLNTT VISMIRAKDD KAFDKSLEDY
KAFLKSNKWD AIEKIKSEKM AENRDKLK

EF019-1 (SEQ ID NO:69)
TAAAGGAGTT ACACAATGAA ACTTTTAAAA AAGACGGTCC TAATTGGTAC AACCCTTCTT
CTTGGTTCAT TCTTACTCGC AGCTTGTGGT AATACGAATA AAGAAGCCAA CAACGCTGAC
AAAACACATG AAGTAACAGA TACCTTAGGC AATAAAGTAA CCGTCCCCGC GAAACCCAAA
CGGATTATTG CGAGTTATTT AGAAGATTAT CTAGTTGCAT TAGGAGAAAA ACCAGTGGCA
CAATGGACAG TTGGACAAGG CAGCATTCAA GATTATTTAG CGAAAGAATT GAAAGATGTC
CCCACTATTT CCTATGACTT GCCATATGAA GCGGTTCTAA AATTTGAACC TGACTTATTA
TTAATCAGTT CATCTGCTCT AGTTGAAGGC GGTAAATACA AAGAATACAG TAAAATTGCG
CCAACTTATG TAGTCAAAAA CGGCGAAAAT GTCACCTGGC GTGATCAATT GGAAGATATT
GCCACTGTTT TAGATAAAAA AGAACAAGCG AAAAAAGTGT TAGAAGATTA TGATACCTTA
ACCAAAGGCG TCCAAGAATA TCTTGGCAAA AAGATGCTG GCAAATCTGC GGCAGTCTTA
TGGGTAACCA ACAACCAAGT CTTTATGGTT AGCGATAATC GCTCAAGCGG AACCGTGCTC
TATCAGGACT TAGGCCTCCA AGTTCCAAAA TTAGTGGAAG AAATTTCTAA AAACGCTACT
GCGGATTGGA ATCAAGTTTC TTTAGAAAAA TTAGCTGAGC TTGACGCAGA CCACATTTTC
CTTGTAAACA GCGATGAATC AGCACCTCTT TTCCAAGAAG CAATTTGGAA GAACTTACCT
GCTGTGAAAA ATAACCAAGT TCATACCTAT GATAAAAAAA GTAGTTGGTT ATACAACGGA
CCTATTGCGA ATACTCAAAT TGTTGAAGAT GTAAAAAAAG CGCTCTTAAA TTAA

EF019-2 (SEQ ID NO:70)
MKLLKK TVLIGTTLLL GSFLLAACGN TNKEANNADK THEVTDTLGN KVTVPAKPKR
IIASYLEDYL VALGEKPVAQ WTVGQGSIQD YLAKELKDVP TISYDLPYEA VLKFEPDLLL
ISSSALVEGG KYKEYSKIAP TYVVKNGENV TWRDQLEDIA TVLDKKEQAK KVLEDYDTLT
KGVQEYLGKK DAGKSAAVLW VTNNQVFMVS DNRSSGTVLY QDLGLQVPKL VEEISKNATA
DWNQVSLEKL AELDADHIFL VNSDESAPLF QEAIWKNLPA VKNNQVHTYD KKSSWLYNGP
IANTQIVEDV KKALLN

EF019-3 (SEQ ID NO:71)
TTGTGGT AATACGAATA AAGAAGCCAA CAACGCTGAC
AAAACACATG AAGTAACAGA TACCTTAGGC AATAAAGTAA CCGTCCCCGC GAAACCCAAA
CGGATTATTG CGAGTTATTT AGAAGATTAT CTAGTTGCAT TAGGAGAAAA ACCAGTGGCA
CAATGGACAG TTGGACAAGG CAGCATTCAA GATTATTTAG CGAAAGAATT GAAAGATGTC
CCCACTATTT CCTATGACTT GCCATATGAA GCGGTTCTAA AATTTGAACC TGACTTATTA
TTAATCAGTT CATCTGCTCT AGTTGAAGGC GGTAAATACA AAGAATACAG TAAAATTGCG
CCAACTTATG TAGTCAAAAA CGGCGAAAAT GTCACCTGGC GTGATCAATT GGAAGATATT
GCCACTGTTT TAGATAAAAA AGAACAAGCG AAAAAAGTGT TAGAAGATTA TGATACCTTA
ACCAAAGGCG TCCAAGAATA TCTTGGCAAA AAGATGCTG GCAAATCTGC GGCAGTCTTA
TGGGTAACCA ACAACCAAGT CTTTATGGTT AGCGATAATC GCTCAAGCGG AACCGTGCTC
TATCAGGACT TAGGCCTCCA AGTTCCAAAA TTAGTGGAAG AAATTTCTAA AAACGCTACT
GCGGATTGGA ATCAAGTTTC TTTAGAAAAA TTAGCTGAGC TTGACGCAGA CCACATTTTC
CTTGTAAACA GCGATGAATC AGCACCTCTT TTCCAAGAAG CAATTTGGAA GAACTTACCT
GCTGTGAAAA ATAACCAAGT TCATACCTAT GATAAAAAAA GTAGTTGGTT ATACAACGGA
CCTATTGCGA ATACTCAAAT TGTTGAAGAT GTAAAAAAAG CGCTCTTAAA T

EF019-4 (SEQ ID NO:72)
CGN TNKEANNADK THEVTDTLGN KVTVPAKPKR
IIASYLEDYL VALGEKPVAQ WTVGQGSIQD YLAKELKDVP TISYDLPYEA VLKFEPDLLL
ISSSALVEGG KYKEYSKIAP TYVVKNGENV TWRDQLEDIA TVLDKKEQAK KVLEDYDTLT
```

TABLE 1-continued

Nucleotide and Amino Acid Seqeuences of E. faecalis Genes.

KGVQEYLGKK DAGKSAAVLW VTNNQVFMVS DNRSSGTVLY QDLGLQVPKL VEEISKNATA
DWNQVSLEKL AELDADHIFL VNSDESAPLF QEAIWKNLPA VKNNQVHTYD KKSSWLYNGP
IANTQIVEDV KKALLN

EF020-1 (SEQ ID NO:73)
TGAGGAGATG AGAAAATGAA AAAGGTAGTT TCAATTTTGT TGATGGTTGT TGCAGTCTTC
ACATTAACTG CATGTAATGG TTCTAAATTA GATAAAACAG GTGAAGAATT TAAAAATTCT
ATAATGAAAG ATTCTTCATA TGGTGATGAA TATTCAGAAG ATGGTTTTAG TTTTTTAATA
TATAAAGATA AAGACACTAA TCGTTATTTG GCTGATGTTT GGGTTCCTGT TAAAGATGAA
ACTAGCGCAT GGAGTATTTT TTATTATTAT GATGAAGATA AGCGATTAGA TAGTACTAAA
AGTAAAGTAA CCTTTGATGA TATGAAAGCT AGTGGAAACT ATGAAGTAGT GTATAAATCA
GGGAAATTTA AATAA

EF020-2 (SEQ ID NO:74)
MKKVVS ILLMVVAVFT LTACNGSKLD KTGEEFKNSI MKDSSYGDEY SEDGFSFLIY
KDKDTNRYLA DVWVPVKDET SALEYFYYYD EDKRLDSTKS KVTFDDMKAS GNYEVVYKSG
KFK

EF020-3 (SEQ ID NO:75)
ATGTAATGG TTCTAAATTA GATAAAACAG GTGAAGAATT TAAAAATTCT
ISSSALVEGG KYKEYSKIAP TYVVKNGENV TWRDQLEDIA TVLDKKEQAK KVLEDYDTLT
KGVQEYLGKK DAGKSAAVLW VTNNQVFMVS DNRSSGTVLY QDLGLQVPKL VEEISKNATA
DWNQVSLEKL AELDADHIFL VNSDESAPLF QEAIWKNLPA VKNNQVHTYD KKSSWLYNGP
IANTQIVEDV KKALLN

EF020-4 (SEQ ID NO:76)
CNGSKLD KTGEEFKNSI MKDSSYGDEY SEDGFSFLIY
KDKDTNRYLA DVWVPVKDET SALEYFYYYD EDKRLDSTKS KVTFDDMKAS GNYEVVYKSG
KFK

EF021-1 (SEQ ID NO:77)
TAGTTGTTTA AATACATTAA ACTATTTTTA GGAGGCTTTA CAGAAATGAA AAAAGCAAAA
TTATTCGGTT TTAGTTTGAT TGCATTAGGT TTATCAGTTT CACTTGCAGC ATGTGGTGGT
GGCAAAGGCA AAACCGCTGA AAGCGGCGGT GGCAAAGGGG ATGCAGCGCA TAGTGCTGTA
ATCATTACAG ATACAGGCGG CGTGGATGAC AAGTCGTTCA ACCAATCTTC TTGGGAAGGA
TTGCAAGCTT GGGGTAAAGA ACATGATTTA CCAGAAGGTT CAAAAGGGTA TGCATATATT
CAATCGAATG ATGCAGCTGA CTATACAACC AATATTGACC AAGCGGTATC AAGTAAATTC
AACACAATCT TTGGTATTGG CTACTTGCTA AAAGATGCAA TTTCTTCTGC AGCAGATGCC
AACCCTGATA CAAACTTTGT TTTAATCGAT GATCAAATCG ATGGCAAAAA GAATGTCGTT
TCTGCAACAT TTAGAGATAA TGAAGCAGCT TACTTAGCCG GTGTTGCTGC TGCAAATGAA
ACAAAAACGA ACAAAGTCGG TTTTGTTGGT GGTGAAGAAG GGGTCGTAAT TGACCGTTTC
CAAGCTGGTT TTGAAAAAGG TGTGGCTGAT GCTGCGAAAA AATTAGGTAA AGAAATTACT
GTTGATACGA AATATGCGGC TTCATTTGCT GATCCTGCCA AAGGGAAAGC TTTAGCTGCT
GCAATGTACC AAAACGGCGT TGATATCATC TTCCATGCTT CTGGTGCGAC TGGACAAGGG
GTCTTCCAAG AAGCAAAAGA CTTGAATGAA T&AGGTTCTG GCGACAAAGT TTGGGTAATC
GGCGTTGACC GCGATCAAGA TGCTGATGGC AAGTACAAAA CAAAAGACGG CAAAGAAGAC
AACTTCACGT TAACTTCAAC GCTTAAAGGT GTCGGCACAG CGGTTCAAGA TATTGCCAAC
CGTGCGTTAG AAGACAAATT CCCTGGTGGC AACATTTAG TTTATGGATT AAAAGATGGT
GGCGTTGACT TAACAGACGG CTATTTAAAC GACAAAACAA AAGAAGCTGT TAAAACAGCA
AAAGATAAAG TAATCTCAGG TGACGTAAAA GTCCCAGAAA ACCAGAATA A

EF021-2 (SEQ ID NO:78)
MKKAKL FGFSLIALGL SVSLAACGGG KGKTAESGGG KGDAAHSAVI
ITDTGGVDDK SFNQSSWEGL QAWGKEHDLP EGSKGYAYIQ SNDAADYTTN IDQAVSSKFN
TIFGIGYLLK DAISSAADAN PDTNFVLIDD QIDGKKNVVS ATFRDNEAAY LAGVAAANET
KTNKVCFVGG EEGVVIDRFQ AGFEKGVADA AKELGKEITV DTKYAASFAD PAKGKALAAA
MYQNGVDIIF HASGATGQGV FQEAKDLNES GSGDKVWVIG VDRDQDADGK YKTKDGKEDN
FTLTSTLKGV GTAVQDIANR ALEDKFPGGE HLVYGLKDGG VDLTDGYLND KTKEAVKTAK
DKVISGDVKV PEKPE

EF021-3 (SEQ ID NO:79)
ATGTGGTGGT
GGCAAAGGCA AAACCGCTGA AAGCGGCGGT GGCAAAGGGG ATGCAGCGCA TAGTGCTGTA
ATCATTACAG ATACAGGCGG CGTGGATGAC AAGTCGTTCA ACCAATCTTC TTGGGAAGGA
TTGCAAGCTT GGGGTAAAGA ACATGATTTA CCAGAAGGTT CAAAAGGGTA TGCATATATT
CAATCGAATG ATGCAGCTGA CTATACAACC AATATTGACC AAGCGGTATC AAGTAAATTC
GGCATGATTC CACTTAGCCA AAATGAACAA ACAGTCCTGC AAAATGATAA AGTCAAAGGC
TTGAATTTTC ATACCTTTGG CGCTCCATTA ACGTTAAAAA ATGTTTATAA GGAAAAATAA

EF021-4 (SEQ ID NO:80)
CGGG KGKTAESGGG KGDAAHSAVI
ITDTGGVDDK SFNQSSWEGL QAWGKEHDLP EGSKGYAYIQ SNDAADYTTN IDQAVSSKFN
TIFGIGYLLK DAISSAADAN PDTNFVLIDD QIDGKKNVVS ATFRDNEAAY LAGVAAANET
KTNKVGFVGG EEGVVIDRFQ AGFEKGVADA AKELGKEITV DTKYAASFAD PAKGKALAAA
MYQNGVDIIF HASGATGQGV FQEAKDLNES GSGDKVWVIG VDRDQDADGK YKTKDGKEDN
FTLTSTLKGV GTAVQDIANR ALEDKFPGGE HLVYGLKDGG VDLTDGYLND KTKEAVKTAK
DKVISGDVKV PEKPE

TABLE 1-continued

Nucleotide and Amino Acid Seqeuences of E. faecalis Genes.

EF022-1 (SEQ ID NO:81)
TAAGAGCATA AAAAAATGAA GAGTTATAGG AGAAAGAAGA TGAAAAAGTA TTTAAAAATC
ACAATGGTTT GTATTTTATT GGTAGGATTT TTAGCTGGGT GTACCAATAA AAATGAAAAT
AAAAAGAAAC AGAAAAATAC CAAAGAAGCC GTTCAACTGA TGTCACCCTC GGAATTAACA
ACGCTCAACA CCTCTGTATT ATTGGATTTT CCAGATGCTA TTGTCCAAAC TGCAGCGTTT
GAAGGGTTAT ATAGTTTAGA TGAACAAGAC CAATTGGTAC CAGCCGTAGC AAAAGCATTG
CCGATGATTT CAGAAGATGG AAAAACCTAC ACGATTTCTT TGAGAAAAGA AGCGGTTTGG
AGTAACGATG ATCCTGTCAC AGCACATGAT TTTGAATATG CTTGGAAAAA AATGATTGAT
CCTAAAAACG GCTTTGTTTA TAGCTTCCTC ATCGTTGAAA CAATTCAAAA TGGTGCAGAA
ATCTCAGCGG GAAATTAGC ACCCAATGAA CTAGGTGTCA CAGCTGTGGA TGATTATACA
TTAAAGGTGA CGCTCAAAGA GCCAAAACCG TACTTTACGT CCTTGTTAGC TTTTCCGACA
TTTTTCCCGC AAAATCNAAA AGTAGTCGAA CAATTTGGTG CGGACTATGG AACTGCTAGT
GATAAAGTCG TCTATAATGG TCCGTTCGTG GTAAAAGATT GGCAGCAAAC AAAGATGGAC
TGGCAACTAG CAAAAAATAA TCGCTATTGG GATCACCAGA ACGTGCGCTC AGACATTATC
AATTATACAG TTATCAAAGA AACATCTACC GCATTGAATC TTTTTGAAGA TGGACAATTA
GATGTGGCTA CACTAAGTGG TGAACTGGCG CAACAGAATA AAAATAATAC GTTGTATCAT
TCGTATCCAA CAGCGACAAT GAACTATTTG CGCTTAAATC AAAAACGGNA AGGGCAAGCN
ACGCCGCTTG CAAACGAAAA CCTGCGTAAA GCATTGGCTT TAGGAATAGA TAAAGAAAAT
CTAGTCAATA ATATTATTGC AGATGGTTCT AAAGCGCTAC ATGGTGCGAT TACGGAAGGC
TTTGTGGCGA ATCCCACAAC GGGTCTCGAT TTTCGTCAAG AAGCAGGTAA TTTAATGGTT
TATAACAAAG AAAAAGCGCA AAGTTATTGG AAAAAAGCAC AAGCAGAATT AGGAGAAAAG
GTTAACGTTG AATTGATGGT AACAGATGAT GGTTCTTACA AAAAAATTGG TGAAAGTTTG
CAAGGCTCGC TACAAGAATT GTTTCCTGGT TTGACAATAG AGCTAACCGC ATTGCCGACT
GAAGCTGCAT TGAACTTTGG GCGAGAAAGT GACTATGATT TATTCTTAAT TTACTGGACA
CCAGACTATC AAGACCCTAT TTCTACCCTG ATGACTTTAT ACAAGGGCAA TGATCGCAAT
TATCAGAACC CTGTCTATGA CAAATTATTA GATGAAGCAG CCACAACCTA TGCCTTAGAG
CCAGAAAAAA GATGGGCGAC ACTGATTGCA GCTGAAAAAG AAGTGATTGA AACGACTGCT
GGCATGATTC CACTTAGCCA AAATGAACAA ACAGTCCTGC AAAATGATAA AGTCAAAGGC
TTGAATTTTC ATACCTTTGG CGCTCCATTA ACGTTAAAAA ATGTTTATAA GGAAAAATAA

EF022-2 (SEQ ID NO:82)
MKKYLKIT MVCILLVGFL AGCTNKNENK KKQKNTKEAV QLMSPSELTT
LNTSVLLDFP DAIVQTAAFE GLYSLDEQDQ LVPAVAKALP MISEDGKTYT ISLRKEAVWS
NDDPVTAHDF EYAWKKMIDP KNGFVYSFLI VETIQNGAEI SAGKLAPNEL GVTAVDDYTL
KVTLKEPKPY FTSLLAFPTF FPQNXKVVEQ FGADYGTASD KVVYNGPFVV KDWQQTKMDW
QLAKNNRYWD HQNVRSDIIN YTVIKETSTA LNLFEDGQLD VATLSGELAQ QNKNNTLYHS
YPTATMNYLR LNQKRXGQAT PLANENLRKA LALGIDKENL VNNIIADGSK ALHGAITEGF
VANPTTGLDF RQEAGNLMVY NKEKAQSYWK KAQAELGEKV NVELMVTDDG SYKKIGESLQ
GSLQELFPGL TIELTALPTE AALNFGRESD YDLFLIYWTP DYQDPISTLM TLYKGNDRNY
QNPVYDKLLD EAATTYALEP EKRWATLIAA EKEVIETTAG MIPLSQNEQT VLQNDKVKGL
NFHTFGAPLT LKMVYKEK

EF022-3 (SEQ ID NO:83)
GT GTACCAATAA AAATGAAAAT
AAAAAGAAAC AGAAAAATAC CAAAGAAGCC GTTCAACTGA TGTCACCCTC GGAATTAACA
ACGCTCAACA CCTCTGTATT ATTGGATTTT CCAGATGCTA TTGTCCAAAC TGCAGCGTTT
GAAGGGTTAT ATAGTTTAGA TGAACAAGAC CAATTGGTAC CAGCCGTAGC AAAAGCATTG
CCGATGATTT CAGAAGATGG AAAAACCTAC ACGATTTCTT TGAGAAAAGA AGCGGTTTGG
AGTAACGATG ATCCTGTCAC AGCACATGAT TTTGAATATG CTTGGAAAAA AATGATTGAT
CCTAAAAACG GCTTTGTTTA TAGCTTCCTC ATCGTTGAAA CAATTCAAAA TGGTGCAGAA
ATCTCAGCGG GAAATTAGC ACCCAATGAA CTAGGTGTCA CAGCTGTGGA TGATTATACA
TTAAAGGTGA CGCTCAAAGA GCCAAAACCG TACTTTACGT CCTTGTTAGC TTTTCCGACA
TTTTTCCCGC AAAATCNAAA AGTAGTCGAA CAATTTGGTG CGGACTATGG AACTGCTAGT
GATAAAGTCG TCTATAATGG TCCGTTCGTG GTAAAAGATT GGCAGCAAAC AAAGATGGAC
TGGCAACTAG CAAAAAATAA TCGCTATTGG GATCACCAGA ACGTGCGCTC AGACATTATC
AATTATACAG TTATCAAAGA AACATCTACC GCATTGAATC TTTTTGAAGA TGGACAATTA
GATGTGGCTA CACTAAGTGG TGAACTGGCG CAACAGAATA AAAATAATAC GTTGTATCAT
TCGTATCCAA CAGCGACAAT GAACTATTTG CGCTTAAATC AAAAACGGNA AGGGCAAGCN
ACGCCGCTTG CAAACGAAAA CCTGCGTAAA GCATTGGCTT TAGGAATAGA TAAAGAAAAT
CTAGTCAATA ATATTATTGC AGATGGTTCT AAAGCGCTAC ATGGTGCGAT TACGGAAGGC
TTTGTGGCGA ATCCCACAAC GGGTCTCGAT TTTCGTCAAG AAGCAGGTAA TTTAATGGTT
TATAACAAAG AAAAAGCGCA AAGTTATTGG AAAAAAGCAC AAGCAGAATT AGGAGAAAAG
GTTAACGTTG AATTGATGGT AACAGATGAT GGTTCTTACA AAAAAATTGG TGAAAGTTTG
CAAGGCTCGC TACAAGAATT GTTTCCTGGT TTGACAATAG AGCTAACCGC ATTGCCGACT
GAAGCTGCAT TGAACTTTGG GCGAGAAAGT GACTATGATT TATTCTTAAT TTACTGGACA
CCAGACTATC AAGACCCTAT TTCTACCCTG ATGACTTTAT ACAAGGGCAA TGATCGCAAT
TATCAGAACC CTGTCTATGA CAAATTATTA GATGAAGCAG CCACAACCTA TGCCTTAGAG
CCAGAAAAAA GATGGGCGAC ACTGATTGCA GCTGAAAAAG AAGTGATTGA AACGACTGCT
GGCATGATTC CACTTAGCCA AAATGAACAA ACAGTCCTGC AAAATGATAA AGTCAAAGGC
TTGAATTTTC ATACCTTTGG CGCTCCATTA ACGTTAAAAA ATGTTTATAA GGAAAAA

EF022-4 (SEQ ID NO:84)
CTNKNENK KKQKNTKEAV QLMSPSELTT
LNTSVLLDFP DAIVQTAAFE GLYSLDEQDQ LVPAVAKALP MISEDGKTYT ISLRKEAVWS
NDDPVTAHDF EYAWKKMIDP KNGFVYSFLI VETIQNGAEI SAGKLAPNEL GVTAVDDYTL
KVTLKEPKPY FTSLLAFPTF FPQNXKVVEQ FGADYGTASD KVVYNGPFVV KDWQQTKMDW

TABLE 1-continued

Nucleotide and Amino Acid Seqeuences of *E. faecalis* Genes.

```
QLAKNNRYWD HQNVRSDIIN YTVIKETSTA LNLFEDGQLD VATLSGELAQ QNKNNTLYHS
YPTATMNYLR LNQKRXGQAT PLANENLRKA LALGIDKENL VNNIIADGSK ALHGAITEGF
VANPTTGLDF RQEAGNLMVY NKEKAQSYWK KAQAELGEKV NVELMVTDDG SYKKIGESLQ
GSLQELFPGL TIELTALPTE AALNFGRESD YDLFLIYWTP DYQDPISTLM TLYKGNDRNY
QNPVYDKLLD EAATTYALEP EKRWATLIAA EKEVIETTAG MIPLSQNEQT VLQNDKVKGL
NFHTFGAPLT LKNVYKEK

EF023-1 (SEQ ID NO:85)
TAAAATGGAG GGATCGGTAT GAAGAAATTA AAAATGTTAG GATGCGTCGG GTTGCTTTTA
GCTTTAACGG CTTGTCAGGC GGGAACGGGA AACTCGGCTG ATAGTAACAA AGCAGCGGAA
CAAAAAATTG CAATTAGTTC TGAAGCGGCT ATTTCGACAA TGGAACCACA CACAGCGGGG
GATACGACCT CGACTTTAGT CATGAATCAA GTTTATGAAG GACTCTATGT TTTAGGTAAA
GAAGATGAAT TAGAGTTGGG GGTCGCTGCC GAAGAACCAG CGATTTCTGA AGATGAAACC
GTTTATACAT TTAAGATTAG AGAAGATGCC AAATGGTCGA ATGATGATCC AGTAACAGCA
AACGACTTTG TTTATGCATG GCAACAAGTT GCTTCCCCTA AATCAGGATC GATTCATCAA
GCTTTATTTT TTGATGTCAT TAAAAATGCT AAGGAAATTG CTTTAGAAGG CGCAGATGTG
AATACTCTTG GGGTTAAGGC GCTAGATGAT AAAACGTTAG AAATAACTTT AGAACGGCCC
ACCCCTTATT TGAAATCATT ACTTTCGTTT CCTGTTTTGT TTCCACAAAA TGAAAAATAT
ATCAAAGAAC AAGGGGATAA ATATGCTACT GATGCAGAAC ATTTGATTTA TAATGGTCCT
TTTAAATTGA AGAATGGGA TAATGCCTCT TCTGATGACT GGACCTACGA AAAAAATGAT
ACGTATTGGG ATGCTGAAAA AGTTAAATTA ACAGAAGCGA AAGTTTCAGT AATTAAGAGC
CCAACGACAG CGGTGAATTT GTTTGACTCG AATGAATTGG ATGTAGTGAA TAAGCTAAGT
GGTGAATTTA TTCCTGGTTA TGTTGATAAT CCAGCCTTTC TTTCAATTCC TCAATTCGTC
ACATACTTTT TAAAAATGAA CAGCGTTCGT GATGGAAAAG AAAATCCGGC TTTAGCGAAC
AACAATATTC GTAAAGCGTT GGCACAAGCT TTTGATAAAG AAAGTTTTGT AAAAGAAGTC
TTGCAAGATC AATCAACGGC TACAGATCAA GTAATTCCGC CGGGACAAAC GATTGCGCCA
GATGGAACAG ATTTTCACAA ACTAGCTGCT AAGAAAAATA ACTACTTAAC CTACGATACA
GCGAAAGCAA AAGAATTCTG GGAAAAAGGG AAAAAGAAA TTGGGCTGGA TAAAATCAAA
TTAGAATTTT TAACAGATGA TACAGACAGC GCCAAAAAAG CTGCTGAGTT TTTCCAATTT
CAATTGGAAG AAAATCTAGA TGGATTAGAA GTGAATGTTA CTCAAGTTCC TTTTACTATT
CGTGTTGATC GTGATCAAAC GAGAGACTAT GATTTAGAAT TATCTGGTTG GGGAACCGAT
TATCGTGATC CATTAACAGT TATGCGCATC TTTACTTCGG ATAGTACCTT GGGCGGCGTA
ACGTTCAAGA GTGATACGTA TGATCAATTA ATTCAAGAAA CTAGAACAAC ACATGCGGCT
GATCAAGAGG CTCGTTTAAA TGACTTTGCT CAAGCACAAG ATATTTTGGT GAATCAGGAA
ACGGTTTTAG CACCAATCTA CAATCGAAGC ATTTCTGTAT TAGCTAATCA AAAAATCAAG
GATCTGTATT GGCATTCATT TGGACCCACG TACAGTTTAA AATGGGCTTA TGTTAACTAA

EF023-2 (SEQ ID NO:86)
MKKLK MLGCVGLLLA LTACQAGTGN SADSNKAAEQ KIAISSEAAI STMEPHTAGD
TTSTLVMNQV YEGLYVLGKE DELELGVAAE EPAISEDETV YTFKIREDAK WSNDDPVTAN
DFVYAWQQVA SPKSGSIHQA LFFDVIKNAK EIALEGADVN TLGVKALDDK TLEITLERPT
PYLKSLLSFP VLFPQNEKYI KEQGDKYATD AEHLIYNGPF KLKEWDNASS DDWTYEKNDT
YWDAEKVKLT EAKVSIKSP TTAVNLFDSN ELDVVNKLSG EFIPGYVDNP AFLSIPQFVT
YFLKNNSVRD GKENPALANN NIRKALAQAF DKESFVKEVL QDQSTATDQV IPPGQTIAPD
GTDFTKLAAK KNNYLTYDTA KAKEFWEKGK KEIGLDKIKL EFLTDDTDSA KKAAEFFQFQ
LEENLDGLEV NVTQVPFTIR VDRDQTRDYD LELSGWGTDY RDPLTVMRIF TSDSTLGGVT
FKSDTYDQLI QETRTTHAAD QEARLNDFAQ AQDILVNQET VLAPIYNRSI SVLANQKIKD
LYWHSFGPTY SLKWAYVN

EF023-3 (SEQ ID NO:87)
GGGAACGGGA AACTCGGCTG ATAGTAACAA AGCAGCGGAA
CAAAAAATTG CAATTAGTTC TGAAGCGGCT ATTTCGACAA TGGAACCACA CACAGCGGGG
GATACGACCT CGACTTTAGT CATCAATCAA GTTTATGAAG GACTCTATGT TTTAGGTAAA
GAAGATGAAT TAGAGTTGGG GGTCGCTGCC GAAGAACCAG CGATTTCTGA AGATGAAACC
GTTTATACAT TTAAGATTAG AGAAGATGCC AAATGGTCGA ATGATGATCC AGTAACAGCA
AACGACTTTG TTTATGCATG GCAACAAGTT GCTTCCCCTA AATCAGGATC GATTCATCAA
GCTTTATTTT TTGATGTCAT TAAAAATGCT AAGGAAATTG CTTTAGAAGG CGCAGATGTG
AATACTCTTG GGGTTAAGGC GCTAGATGAT AAAACGTTAG AAATAACTTT AGAACGGCCC
ACCCCTTATT TGAAATCATT ACTTTCGTTT CCTGTTTTGT TTCCACAAAA TGAAAAATAT
ATCAAAGAAC AAGGGGATAA ATATGCTACT GATGCAGAAC ATTTGATTTA TAATGGTCCT
TTTAAATTGA AGAATGGGA TAATGCCTCT TCTGATGACT GGACCTACGA AAAAAATGAT
ACGTATTGGG ATGCTGAAAA AGTTAAATTA ACAGAAGCGA AAGTTTCAGT AATTAAGAGC
CCAACGACAG CGGTGAATTT GTTTGACTCG AATGAATTGG ATGTAGTGAA TAAGCTAAGT
GGTGAATTTA TTCCTGGTTA TGTTGATAAT CCAGCCTTTC TTTCAATTCC TCAATTCGTC
ACATACTTTT TAAAAATGAA CAGCGTTCGT GATGGAAAAG AAAATCCGGC TTTAGCGAAC
AACAATATTC GTAAAGCGTT GGCACAAGCT TTTGATAAAG AAAGTTTTGT AAAAGAAGTC
TTGCAAGATC AATCAACGGC TACAGATCAA GTAATTCCGC CGGGACAAAC GATTGCGCCA
GATGGAACAG ATTTTCACAA ACTAGCTGCT AAGAAAAATA ACTACTTAAC CTACGATACA
GCGAAAGCAA AAGAATTCTG GGAAAAAGGG AAAAAGAAA TTGGGCTGGA TAAAATCAAA
TTAGAATTTT TAACAGATGA TACAGACAGC GCCAAAAAAG CTGCTGAGTT TTTCCAATTT
CAATTGGAAG AAAATCTAGA TGGATTAGAA GTGAATGTTA CTCAAGTTCC TTTTACTATT
CGTGTTGATC GTGATCAAAC GAGAGACTAT GATTTAGAAT TATCTGGTTG CCCAACCGAT
TATCGTGATC CATTAACAGT TATGCGCATC TTTACTTCGG ATAGTACCTT GGGCGGCGTA
ACGTTCAAGA GTGATACGTA TGATCAATTA ATTCAAGAAA CTAGAACAAC ACATGCGGCT
GATCAAGAGG CTCGTTTAAA TGACTTTGCT CAAGCACAAG ATATTTTGGT GAATCAGGAA
ACGGTTTTAG CACCAATCTA CAATCGAAGC ATTTCTGTAT TAGCTAATCA AAAAATCAAG
GATCTGTATT GGCATTCATT TGGACCCACG TACAGTTTAA AATGGGCTTA TGTTAAC
```

TABLE 1-continued

Nucleotide and Amino Acid Seqeuences of *E. faecalis* Genes.

EF023-4 (SEQ ID NO:88)
GTGN SADSNKAAEQ KIAISSEAAI STMEPHTAGD
TTSTLVMNQV YEGLYVLGKE DELELGVAAE EPAISEDETV YTFKIREDAK WSNDDPVTAN
DFVYAWQQVA SPKSGSIHQA LFFDVIKNAK EIALEGADVN TLGVKALDDK TLEITLERPT
PYLKSLLSFP VLFPQNEKYI KEQGDKYATD AEHLIYNGPF KLKEWDNASS DDWTYEKNDT
YWDAEKVKLT EAKVSVIKSP TTAVNLFDSN ELDVVNKLSG EFIPGYVDNP AFLSIPQFVT
YFLKMNSVRD GKENPALANN NIRKALAQAF DKESFVKEVL QDQSTATDQV IPPGQTIAPD
GTDFTKLAAK KNNYLTYDTA KAKEFWEKGK KEIGLDKIKL EFLTDDTDSA KKAAEFFQFQ
LEENLDGLEV NVTQVPFTIR VDRDQTRDYD LELSGWGTDY RDPLTVMRIF TSDSTLGGVT
FKSDTYDQLI QETRTTHAAD QEARLNDFAQ AQDILVNQET VLAPIYNRSI SVLANQKIKD
LYWHSFGPTY SLKWAYVN

EF024-1 (SEQ ID NO:89)
TAATGGCCGT TTCGTCTACT AATAAAGAGG ATGAAGCTAC TCAAATGGCG TTGGCAATGG
AACAAGGATC ATAAAAAAGG AGAAGTGAGC ATGAAAAAAG TACTACCTTT TATTGCCTTA
GTCGGCTTGT TATTGTTGTC AGGTTGTGGA ACAGATATGA AAAAGATATT GACTGCCGAT
GGTGGTAAAT GGAAAGTGGA AGAAACACGT GCAACTTACA CTTTTTTTGA TGACGGTAAA
TTTTCAGCTA ATGACTCAGA GGATAGTGTT AGTGGGACAT ACACTTATGA TGAAAAAAAT
AAAAAAATAA CCTTTGACNT TACTAGCAGN AACTCTTTCA TTATGGAAAA AGTNGANTNC
AANGNTANCA AGATTACAGG GGAAATTGGC GAAAAACAAA GAACACTTAT AAAACAAAAA
ACAGAATAA

EF024-2 (SEQ ID NO:90)
M KKVLPFIALV GLLLLSGCGT DMKKILTADG
GKWKVEETRA TYTFFDDGKF SANDSEDSVS CTYTYDEKNK KITFDXTSXN SFIMEKVXXX
XXKITGEIGE KQRTLIKQKT E

EF024-3 (SEQ ID NO:91)
ATT GACTGCCGAT
GGTGGTAAAT GQAAAGTGGA AGAAACACGT GCAACTTACA CTTTTTTTGA TGACGGTAAA
TTTTCAGCTA ATGACTCAGA GGATAGTGTT AGTGGGACAT ACACTTATGA TGAAAAAAAT
AAAAAAATAA CCTTTGACNT TACTAGCAGN AACTCTTTCA TTATGGAAAA AGTNGANTNC
AANGNTANCA AGATTACAGG GGAAATTGGC GAAAAACAAA GAACACTTAT AAAACAAAAA
ACAGAA

EF024-4 (SEQ ID NO:92)
LTADG
GKWKVEETPA TYTFFDDGKF SANDSEDSVS GTYTYDEKNK KITFDXTSXN SFIMEKVXXX
XXKITGEIGE KQRTLIKQKT E

EF025-1 (SEQ ID NO:93)
TGAATGAAAC ATATTAAAGG AATGTTGGTT TTTATCGGAT TATTTATTTT GGTTGGTTGT
GCGCCAGATC AAGAGCCAAC GAAACAAACA ACAAGTGGTC CGCAAGAGAC AAAGCAAGTG
AAGCAAGTTA CCGTCACCAA TCAAACGACT TCTGCGGTGG AAAAACAAGC GCCGACTAAA
AATGACGAAC TGATTGCTAA TCAATTGACT TTTGATTCTC ATGAATACAC GTACGAAGTG
GTTACAGGGG CCACACAAAC GACATTTGGA ACAACCCCAC CAGCAAAATA TACACCGGAA
GAAAAAAAGA AAAAAATGTT TTGGTCCAAT CAACCGCCTT TGGGATTAAT GACGGGTAAC
TATTATAAAA ATGAAGGTGT ATTTACTGGC GGAAATTACG GCATTGTAGA GATTATTACG
GAACCTGAAA CGCAAAGGAT TCTGAATGTT GAGTTTACAG AGTTTGCTAG TGATCCTTAT
TATGATACAC GCTATTCGGG TGTCAACAAA CGCCTGTCGG ATTATCCTGA ATTTCAAGCA
AGCAACACGC GTACAGACGA TACGTTAGTC ACCGTTGTTA ATGGTATTAC TTATGTAGAA
AAACAAATGC GTGACGAAAA TCGTGTTACA GGTAATTTTT ATACGGTACG CGGTTCATCA
ACTTCTGCGC GTGAAGGATT AATGCCTTTA GCAGCAGAGA TGGACACTTG GCTAAAAGAG
CCATCGAAAG AAACGTATAT CGGTTACGCA GAAGATTTAG GCAATGGCCT AATCGCTCGA
CTTCAAGTGA TAACAGAAGA GCAGAAAATA AAACATGTCA GCTATGATGA ATACTTTTCA
GATGAACAGG AAAAAATCAC AGAAACAGCC TGCGGCCTTT TTATCGTCAA TCGAAATATT
ATTCACCAGG ATACAATAAA CAAACCAACA ATTCTTTTAT TCATTTTGTA G

EF025-2 (SEQ ID NO:94)
MKHIKGMLVF IGLFILVGCA PDQEPTKQTT SGPQETKQVK QVTVTNQTTS AVEKQAPTKN
DELIANQLTF DSHEYTYEVV TGATQTTFGT TPPAKYTPEE KKKKMFWSNQ PPLGLMTGNY
YKNEGVFTGG NYGIVEIITE PETQRILNVE FTEFASDPYY DTRYSGVNKR LSDYPEFQAS
NTRTDDTLVT VVNGITYVEK QMRDENRVTG NFYTVRGSST SAREGLMPLA AEMDTWLKEP
SKETYIGYAE DLGNGLIARL QVITEEQKIK HVSYDEYFSD EQEKITETAC GLFIVNRNII
HQDTINKPTI LLFIL

EF025-3 (SEQ ID NO:95)
AAC GAAACAAACA ACAAGTGGTC CGCAAGAGAC AAAGCAAGTG
AAGCAAGTTA CCGTCACCAA TCAAACGACT TCTGCGGTGG AAAAACAAGC GCCGACTAAA
AATGACGAAC TGATTGCTAA TCAATTGACT TTTGATTCTC ATGAATACAC GTACGAAGTG
GTTACAGGGG CCACACAAAC GACATTTGGA ACAACCCCAC CAGCAAAATA TACACCGGAA
GAAAAAAAGA AAAAAATGTT TTGGTCCAAT CAACCGCCTT TGGGATTAAT GACGGGTAAC
TATTATAAAA ATGAAGGTGT ATTTACTGGC GGAAATTACG GCATTGTAGA GATTATTACG
GAACCTGAAA CGCAAAGGAT TCTGAATGTT GAGTTTACAG AGTTTGCTAG TGATCCTTAT
TATGATACAC GCTATTCGGG TGTCAACAAA CGCCTGTCGG ATTATCCTGA ATTTCAAGCA
AGCAACACGC GTACAGACGA TACGTTAGTC ACCGTTGTTA ATGGTATTAC TTATGTAGAA

TABLE 1-continued

Nucleotide and Amino Acid Seqeuences of E. faecalis Genes.

```
AAACAAATGC GTGACGAAAA TCGTGTTACA GGTAATTTTT ATACGGTACG CGGTTCATCA
ACTTCTGCGC GTGAAGGATT AATGCCTTTA GCAGCAGAGA TGGACACTTG GCTAAAAGAG
CCATCGAAAG AAACGTATAT CGGTTACGCA GAAGATTTAG GCAATGGCCT AATCGCTCGA
CTTCAAGTGA TAACAGAAGA GCAGAAAATA AAACATGTCA GCTATGATGA ATACTTTTCA
GATGAACAGG AAAAAATCAC AGAAACAGCC TGCGGCCTTT TTATCGTCAA TCGAAATATT
ATTCACCAGG ATACAATAAA CAAACCAACA ATTCTTTTAT TCATTTTG

EF025-4 (SEQ ID NO:96)
TKQTT SGPQETKQVK QVTVTNQTTS AVEKQAPTKN
DELIANQLTF DSHEYTYEVV TGATQTTFGT TPPAKYTPEE KKKKMFWSNQ PPLGLMTGNY
YKNEGVFTGG NYGIVEIITE PETQRILNVE FTEFASDPYY DTRYSGVNKR LSDYPEFQAS
NTRTDDTLVT VVNGITYVEK QMRDENRVTG NFYTVRGSST SAREGLMPLA AEMDTWLKEP
SKETYIGYAE DLGNGLIARL QVITEEQKIK HVSYDEYFSD EQEKITETAC GLFIVRRNII
HQDTINKPTI LLFIL

EF026-1 (SEQ ID NO:97)
TGAGTGTATG ATTACTCATT TCCCTTTGAA TCAGTTATGA TAAAGGAAGA AATAAATAAA
TTTTTTGGAG GGATTTTCAT GAAAATGTCT AAAGTACTCA CCACTGTTTT GACGGCAACT
GCTGCTCTTG TGTTGCTTAG TGCTTGTTCA TCTGATAAAA AAACAGATAG TAGTTCTAGT
AGCAAAGAAA CAGCTAATTC AAGTACAGAA GTAGTCTCTG GTGCTTCAAT TAGTGCCAAG
CCTGAAGAGC TCGAAATGGC GTTAAGTGAT AAAGGAAATT GGATTGTCGC AGCTACTGAC
AATGTCACTT TTGATAAAGA GGTAACAGTT GCTGGTACTT TCCATGATAA GGGGAAAGAT
TCCAACGATG TCTATCGTAA ATTAGCACTT TATTCCCAAG ATGATAATAA AAAAGTAACT
GCTGAATATG AAATCACGGT TCCTAAGCTA ATCGTTTCTT CTGAAAATTT CAACATCGTT
CACGGGACTG TCAAGGTGA TATTGAGGTG AAAGCAAATG GCTTTACTTT AAATGGTACC
AAAGTTAATG GCAATATTAC TTTTGATAAA CAAGAATACA AGATTCTGC TGACTTAGAA
AAAGATGGTG CCACTGTTAC TGGTGAAGTC ACCGTAGCCA ATAATTAA

EF026-2 (SEQ ID NO:98)
MKMSK VLTTVLTATA ALVLLSACSS DKKTDSSSSS
KETANSSTEV VSGASISAKP EELEMALSDK GNWIVAATDN VTFDKEVTVA GTFHDKGKDS
NDVYRKLALY SQDDNKKVTA EYEITVPKLI VSSENFNIVH GTVKGDIEVK ANGFTLNGTK
VNGNITFDKQ EYKDSADLEK DGATVTGEVT VANN

EF026-3 (SEQ ID NO:99)
AACAGATAG TAGTTCTAGT
AGCAAAGAAA CAGCTAATTC AAGTACAGAA GTAGTCTCTG GTGCTTCAAT TAGTGCCAAG
CCTGAAGAGC TCGAAATGGC GTTAAGTGAT AAAGGAAATT GGATTGTCGC AGCTACTGAC
AATGTCACTT TTGATAAAGA GGTAACAGTT GCTGGTACTT TCCATGATAA GGGGAAAGAT
TCCAACGATG TCTATCGTAA ATTAGCACTT TATTCCCAAG ATGATAATAA AAAAGTAACT
GCTGAATATG AAATCACGGT TCCTAAGCTA ATCGTTTCTT CTGAAAATTT CAACATCGTT
AAAGTTAATG GCAATATTAC TTTTGATAAA CAAGAATACA AGATTCTGC TGACTTAGAA
AAAGATGGTG CCACTGTTAC TGGTGAAGTC ACCGTAGCCA ATAAT

EF026-4 (SEQ ID NO:100)
TDSSSSS
KETANSSTEV VSGASISAKP EELEMALSDK GNWIVAATDN VTFDKEVTVA GTFHDKGKDS
NDVYRKLALY SQDDNKKVTA EYEITVPKLI VSSENFNIVH GTVKGDIEVK ANGFTLNGTK
VNGNITFDKQ EYKDSADLEK DGATVTGEVT VANN

EF027-1 (SEQ ID NO:101)
TTTGGTATGA AACAGAAAAA GTGGTTAATC GGACTTGTTG CACTGGGCTT GGTTTTAGCA
GCATGTGGAA GTGGCGGTTC GAAAACGACC TCAAACGAAC CAGCTACACA GAAAATTAAC
GTCGCATCTG GTGGTGAACT CTCGACATTA GACAGCGCTC ATTATACAGA TGTCTATAGT
TCCGATATGA TTGGTCAAGT AGTTGAAGGC TTGTATCGAC AAGATAAAAA CGGAGATCCT
GAGCTAGCTA TGGCGAAAGC AGAGCCACAC GTTAGTGAAG ACGGGTTAGT CTATACATTC
AAGTTACGAG AAGCAAATG GACAAACGG GATCCAGTTA AAGCAGGGA TTTTGTAGTT
GCGTTTAGAA ACGTGGTCGA TCCAGCATAC GGTTCAAGTA GCAGTAATCA AATGGATATT
TTTAAAAATG GGCGTGCGGT GCGGGAAGGA CAAGCCACGA TGGAAGAATT TGGTGTCAAA
GCAATCGATG ACCAGACACT AGAACTAACA TTGGAAAATC CAATTCCTTA TTTAGCCCAA
GTCTTGGTTG GACACCTTT TATGCCTAAA AATGAAGCCT TGCCAAAGA AAAAGGTACT
GCCTATGGGA CTTCTGCAGA TAATTTTGTT GGCAATGGGC CGTTTGTAAT TTCAGGTTGG
GATGGCAATT CCGAAACTTG GAAATTGAAG AAGAATGAC ATTATTGGGA TAAAGAACAC
GTAAAATTGA ATGAAATTGA TGTTCAAGTA GTGAAAGAAA TTGGCACAGG AGCCAATCTT
TTTGATAATG GCGACTTAGA TTACACTGTT TTAGCAGATA CTTATGCACT TCAGTATAAA
GAGTCAAAAC AAGCGCATTT TGTACCTAAA GCCATGGTGG GTTATTTAAG CCCCAATCAT
CGCCGTGAAA TTACCGGCAA CGAACATGTT CGAAAAGCTT TTTTACAAGC GATTGACAAA
GAAACTTTTG CAAAGAAAT TTAGGAGAT GGCTCGACAG CTTTAAATGG NTTTGTACCA
GCTAATTTTG CAAAAATCCA GATACAGGTG AAGATTCCG CAAAGAAAAT GGTGATTTAT
TGCCATATAA TATTAAAGAA GCCCAAGCTA ACTGGAACAA TT

EF027-2 (SEQ ID NO:102)
MKQKKWLI GLVALGLVLA ACGSGGSKTT SNEPATQKIN VASGGELSTL DSAHYTDVYS
SDMIGQVVEG LYRQDKNGDP ELAMAKAEPQ VSEDGLVYTF KLREAKWTNG DPVKAGDFVV
AFRNVVDPAY GSSSSNQMDI FKNGRAVREG QATMEEFGVK AIDDQTLELT LENPIPYLAQ
VLVGTPFMPK NEAFAKEKGT AYGTSADNFV GNGPFVISGW DGNSETWKLK KNDHYWDKEH
VKLNEIDVQV VKEIGTGANL FDNGDLDYTV LADTYALQYK ESKQAHFVPK AMVGYLSPNH
```

TABLE 1-continued

Nucleotide and Amino Acid Seqeuences of E. faecalis Genes.

RREITGNEHV RKAFLQAIDK ETFAKEILGD GSTALNGFVP ANFAKIQIQV KISAKKMVIY
CHIILKKPKL TGTI

EF027-3 (SEQ ID NO:103)
AACGACCTCAAACGAAC CAGCTACACA GAAAATTAAC
GTCGCATCTG GTGGTGAACT CTCGACATTA GACAGCGCTC ATTATACAGA TGTCTATAGT
TCCGATATGA TTGGTCAAGT AGTTGAAGGC TTGTATCGAC AAGATAAAAA CGGAGATCCT
GAGCTAGCTA TGGCGAAAGC AGAGCCACAA GTTAGTGAAG ACGGGTTAGT CTATACATTC
AAGTTACGAG AAGCAAAATG GACAAACGGG GATCCAGTTA AAGCAGGGGA TTTTGTAGTT
GCGTTTAGAA ACGTGGTCGA TCCAGCATAC GGTTCAAGTA GCAGTAATCA AATGGATATT
TTTAAAAATG GGCGTGCGGT GCGGGAAGGA CAAGCCACGA TGGAAGAATT TGGTGTCAAA
GCAATCGATG ACCAGACACT AGAACTAACA TTGGAAAATC CAATTCCTTA TTTAGCCCAA
GTCTTGGTTG GGACACCTTT TATGCCTAAA AATGAAGCCT TTGCCAAAGA AAAAGGTACT
GCCTATGGGA CTTCTGCAGA TAATTTTGTT GGCAATGGGC CGTTTGTAAT TTCAGGTTGG
GATGGCAATT CCGAAACTTG GAAATTGAAG AAGAATGATC ATTATTGGGA TAAAGAACAC
GTAAAATTGA ATGAAATTGA TGTTCAAGTA GTGAAAGAAA TTGGCACAGG AGCCAATCTT
TTTGATAATG GCGAQTTAGA TTACACTGTT TTAGCAGATA CTTATGCACT TCAGTATAAA
GAGTCAAAAC AAGCGCATTT TGTACCTAAA GCCATGGTGG GTTATTTAAG CCCCAATCAT
CGCCGTGAAA TTACCGGCAA CGAACATGTT CGAAAAGCTT TTTTACAAGC GATTGACAAA
GAAACTTTTG CAAAAGAAAT TTTAGGAGAT GGCTCGACAG CTTTAAATGG NTTTGTACCA
GCTAATTTTG CAAAAATCCA GATACAGGTG AAGATTTCCG CAAAGAAAAT GGTGATTTAT
TGCCATATAA TATTAAAGAA GCCCAAGCTA A

EF027-4 (SEQ ID NO:104)
TT SNEPATQKIN VASGGELSTL DSAHYTDVYS
SDMIGQVVEG LYRQDKNGDP ELAAAKAEPQ VSEDGLVYTF KLREAKWTNG DPVKAGDFVV
AFFNVVDPAY GSSSSNQMDI FKNGRAVREG QATMEEFGVK AIDDQTLELT LENPIPYLAQ
VLVGTPFMPK NEAFAKEKGT AYGTSADNFV GNGPFVISGW DGNSETWKLK KNDHYWDKEH
VKLNEIDVQV VKETGTGANL FDNGDLDYTV LADTYALQYK ESKQAHFVPK ANVGYLSPNH
RREITGNEHV RKAFLQAIDK ETFAKEILGD GSTALNGFVP ANFAKIQIQV KISAKKNVIY
CHI ILKKPKL

EF028-1 (SEQ ID NO:105)
TAACAGAAGC AATACAACAA CTTAACACTT TGTTTACTTG TTATTTATCA GAAATCAACT
AAGACTTGTT ATAGTCAATG TATGGGTAGA TATGAAGGAG GAAACAAGGA AATGAAGAAA
AGAGCTTTGC TAGGGGTTAC CTTATTAACA TTCACAACAT TAGCGGGTTG TACAAATTTA
TCTGAACAGA AAAGCGGCGA AAAACAAACA GAGGTTGCTG AAGCGAAGGC AACTGAATCT
GAAAAAGCAT CAGTAAAAAA TGTTATTTTT ATGATTGGAG ATGGCATGGG GAATCCGTAT
ACAACGGGCT ATCGCTATTT CAAAGCCAAT CACTCAGACA AGCGTGTTCC CCAAACAGCT
TTTGATACCT ATTTGGTCGG ACAGCAAGCC ACTTATCCAG AAGATGAAGA AGAGAATGTC
ACCGATTCAG CTTCCGCAGC GACAGCGATG GCTGCCGGAG TGAAAACCTA TAATAATGCT
ATTGCACTCG ATAATGACAA GTCCAAAACA GAAACAGTTC TCGAACGTGC GAAAAAAGTG
GGGAAATCAA CGGGTCTTGT AGCAACATCT GAAATAACAC ATGCAACCCC TGCTGCATAT
GGCGCACATA ATGTTTCACG CAAAAATATG GCAGAAATCG CCGATGACTA TTTTGATGAT
CAAATCGACG GACAACACAA AGTCGATGTG TTACTTGGCG GCGGCTCCGA ATTATTTGCC
CGGAAAGATC GTGATTTAGT CAAAGAATTT TCCCAAGCGG GTTATGGTCA TGTCACAGAC
AAAAAGTCGT TAAATGAGAA CCAAGACGAC AAAAATTTTAG GCTTGTTTGC ACCAGGCGGG
CTACCTAAAA TGATTGACCG AACGGAAGAA GTCCCTTCAT TAGCTGATAT GACAGAAGCG
GCTCTTCAAC GGTTAGATAA AAATGAAAAA GGTTTCTTTT TAATGGTTGA AGGTAGTCAA
ATTGATTGGG CCGGGCATAG CAATGATATT GTTGGCGCGA TGAGCGAAAT GCAAGACTTC
GAAGCGGCGT TTGAAAAGGC CATCGATTTT GCCAAAAAAG ATGGTGAACA TTGGTGGTTA
CAACTGCAGA TCATTCAACA GGGGGCTTGT CTTTAG

EF028-2 (SEQ ID NO:106)
MKKR ALLGVTLLTF TTLAGCTNLS
EQKSGEKQTE VAEAKATESE KASVKNVIFM IGDGMGNPYT TGYRYFKANH SDKRVPQTAF
DTYLVGQQAT YPEDEEENVT DSASAATAMA AGVKTYNNAI ALDNDKSKTE TVLERAKKVG
KSTGLVATSE ITHATPAAYG AHNVSRKNMA EIADDYFDDQ IDGQHKVDVL LGGGSELFAR
KDPDLVKEFS QAGYGHVTDK KSLNENQDDK ILGLFAPGGL PKMIDRTEEV PSLADMTEAA
LQRLDKNEKG FFLMVEGSQI DWAGHSNDIV GAMSEMQDFE AAFEKAIDFA KKDGEHWWLQ
LQI IQQGACL

EF028-3 (SEQ ID NO:107)
ACAGA AAAGCGGCGA AAAACAAACA GAGGTTGCTG AAGCGAAGGC AACTGAATCT
GAAAAAGCAT CAGTAAAAAA TGTTATTTTT ATGATTGGAG ATGGCATGGG GAATCCGTAT
ACAACGGGCT ATCGCTATTT CAAAGCCAAT CACTCAGACA AGCGTGTTCC CCAAACAGCT
TTTGATACCT ATTTGGTCGG ACAGCAAGCC ACTTATCCAG AAGATGAAGA AGAGAATGTC
ACCGATTCAG CTTCCGCAGC GACAGCGATG GCTGCCGGAG TGAAAACCTA TAATAATGCT
ATTGCACTCG ATAATGACAA GTCCAAAACA GAAACAGTGC TCGAACGTGC GAAAAAAGTG
GGGAAATCAA CGGGTCTTGT AGCAACATCT GAAATAACAC ATGCAACCCC TGCTGCATAT
GGCGCACATA ATGTTTCACG CAAAAATATG GCAGAAATCG CCGATGACTA TTTTGATGAT
CAAATCGACG GACAACACAA AGTCGATGTG TTACTTGGCG GCGGCTCCGA ATTATTTGCC
CGGAAAGATC GTGATTTAGT CAAAGAATTT TCCCAAGCGG GTTATGGTCA TGTCACAGAC
AAAAAGTCGT TAAATGAGAA CCAAGACGAC AAAAATTTTAG GCTTGTTTGC ACCAGGCGGG
CTACCTAAAA TGATTGACCG AACGGAAGAA GTCCCTTCAT TAGCTGATAT GACAGAAGCG
GCTCTTCAAC GGTTAGATAA AAATGAAAAA GGTTTCTTTT TAATGGTTGA AGGTAGTCAA
ATTGATTGGG CCGGGCATAG CAATGATATT GTTGGCGCGA TGAGCGAAAT GCAAGACTTC

TABLE 1-continued

Nucleotide and Amino Acid Seqeuences of *E. faecalis* Genes.

```
GAAGCGGCGT TTGAAAAGGC CATCGATTTT GCCAAAAAAG ATGGTGAACA TTGGTGGTTA
CAACTGCAGA TCATTCAACA GGGGGCTTGT CTT

EF028-4 (SEQ ID NO:108)
QKSGEKQTE VAEAKATESE KASVKNVIFM IGDGMGNPYT TGYRYFKANH SDKRVPQTAF
DTYLVGQQAT YPEDEEENVT DSASAATAMA AGVKTYNNAI ALDNDKSKTE TVLERAKKVG
KSTGLVATSE ITHATPAAYG AHNVSRKMMA EIADDYFDDQ IDGQHKVDVL LGGGSELFAR
KDRDLVKEFS QAGYGHVTDK KSLNENQDDK ILGLFAPGGL PKMIDRTEEV PSLADMTEAA
LQRLDKNEKG FFLMVEGSQI DWAGHSNDIV GAMSEMQDFE AAFEKAIDFA KKDGEHWWLQ
LQI IQQGACL

EF029-1 (SEQ ID NO:109)
TGAAGGAGGG AGAAAATGAA AAAGTTAATC GGTAAAAAGT GGCTGCTGCT TACAGCAGTA
GCCACTTTTT TATTATCAGG ATGCGCAAGT CTTGAACAAA AAGCACAGGA TAGTGTAAAA
GAAGTTACTG AAAATGTTAC TCAAACTATT TCAAACGATC AACGTATACC AGCTGATTTT
GTTAGGCACG TGGATGGCGA TACCACAGTA TTAAAAATTG ACGGAAAAGA ACAAAAAGTT
CGGTTTTTAT TAATTGACAC ACCCGAGACT GTGAAACCGA AAACAAAAGT TCAGCCGTTC
GGATTGGAAG CTAGCAAACG CACAAAAGAG CTTTTGTCTA CTGCTTCAGA AATTACGTTT
GAATATGATA AGGGCGATAA AACAGATCGT TACGGACGAG CGTTGGGCTA CATATTCGTA
GATGGAACAT TACTACAAAA AACGCTTGTA AGTGAAGGAT TAGCTCGTGT TGCCTATGTA
AAAGAGCCTA CAACTAAGTA TTTGGCAGAA CTAGAGCAAG CCCAAGAACA GGCTAAAAAT
GAGTCACTCG GAATCTGGAG CATACCAGGT TATGTGCACA ACGGGGGTT TAGTAAATAA

EF029-2 (SEQ ID NO:110)
MKKLIG KKWLLLTAVA TFLLSGCASL EQKAQDSVKE VTENVTQTIS NDQRIPADFV
RHVDGDTTVL KIDGKEQKVR FLLIDTPETV KPKTKVQPFG LEASKRTKEL LSTASEITFE
YDKGDKTDRY GRALGYIFVD GTLLQKTLVS EGLARVAYVK EPTTKYLAEL EQAQEQAKNE
SLGIWSIPGY VTQRGFSK

EF029-3 (SEQ ID NO:111)
AAATGTTAC TCAAACTATT TCAAACGATC AACGTATACC AGCTGATTTT
GTTAGGCACG TGGATGGCGA TACCACAGTA TTAAAAATTG ACGGAAAAGA ACAAAAAGTT
CGGTTTTTAT TAATTGACAC ACCCGAGACT GTGAAACCGA AAACAAAAGT TCAGCCGTTC
GGATTGGAAG CTAGCAAACG CACAAAAGAG CTTTTGTCTA CTGCTTCAGA AATTACGTTT
GAATATGATA AGGGCGATAA AACAGATCGT TACGGACGAG CGTTGGGCTA CATATTCGTA
GATGGAACAT TACTACAAAA AACGCTTGTA AGTGAAGGAT TAGCTCGTGT TGCCTATGTA
AAAGAGCCTA CAACTAAGTA TTTGGCAGAA CTAGAGCAAG CCCAAGAACA GGCTAAAAAT
GAGTCACTCG GAATCTGGAG CATACCAGGT TATGTGCACA ACGGGGGTT TAGTAAA

EF029-4 (SEQ ID NO:112)
NVTQTIS NDQRIPADFV
RHVDGDTTVL KIDGKEQKVR FLLIDTPETV KPKTKVQPFG LEASKRTKEL LSTASEITFE
YDKGDKTDRY GRALGYIFVD GTLLQKTLVS EGLARVAYVK EPTTKYLAEL EQAQEQAKNE
SLGIWSIPGY VTQRGFSK

EF030-1 (SEQ ID NO:113)
TGATTGACAC ATAGGGGAA TAGTATGAAA AAGTTAAAAA TGATGGGAT TATGTTATTT
GTTAGTACGG TCTTGGTAGG TTGTGGCACA ACAGCAGANA CAAAAATAGA CGAGAAAGCA
ACTGAGAAAA CCAGTGTCTC GAAAAAAGTT TTAAATTTAA TGGAGAACTC GGAAATCGGT
TCAATGGATT CTATTTTTAC ACAAGATGAA GCCAGTATTA ACGCACAGTC CAATGTCTTT
GAAGGGTTAT ATCAATTGGA TGAAAAAGAT CAACTAATAC CTGCTGCTGC TAAAGAGATG
CCAGAAATTT CTGAGGATGG CAAACGTATAT ACCATTAAAC TAAGAGAAGA TGGCAAGTGG
TCCAATGGTG ATGCTGTAAC AGCCAATGAT TTCGTTTTTG CTTGGCGTAA ATTAGCGAAT
CCCAAAAACC AAGCCAATTA CTTTTTCTTG TTAGAAGGAA CGATTCTGAA CGGAACAGCT
ATTACAAAAG AGGAAAAAGC ACCAGAGGAA TTGGGTGTCA AAGCGCTTGA TGATTATACT
TTGGAGGTTA CTTTAGAAAA GCCTGTACCA TATTTTACGT CGTTATTGGC ATTTTCTCCA
TTTTTCCCAC AAAACGAAGC ATTCGTGAAA GAAAAAGGAC AAGCCTATGG CACTTCTAGT
GAAATGATTG TATCTAATGG TCCGTTTTTA ATGAAAAATT GGGATCAGTC AGCGATGTCG
TGGGATTTTG TGCGTAATCC CTACTATTAC GATAAAGAAA AAGTAAAATC AGAAACGATT
CATTTTGAAG TTCTTAAAGA AACCAATACC GTTTATAATT TGTACGAATC AGGTGAATTA
GATGTGGCTG TCTTAACAGG AGATTTTGCT AAACAAAATC GAGACAACCC AGACTATGAA
GCAATCGAAC GGTCAAAAGT CTATTCCTTA CGTTTAAACC AAAAAAGAAA CGAAAAACCA
TCCATTTTTG CAAATGAGAA TGTCCGCAAA GCTTTAGCTT ATGCTTTGGA TAAAAAAGT
TTAGTCGATA ATATTTTAGC AGATGGCTCA AAAGAAATTT ATGGGTACAT TCCAGAAAAA
TTTGTATATA ACCCAGAAAC GAATGAAGAT TTCGTCAAG AAGCAGGCGC TCTTGTCAAA
ACAGACGCCA AAAAAGCCAA AGAGTATTTA GATAAAGCAA AGCAGAGCT AAACGGAGAT
GTAGCCATTG AACTTCTTTC AAGAGATGGT GATAGTGACC GA

EF030-2 (SEQ ID NO:114)
MKK LKMMGIMLFV STVLVGCGTT AXTKIDEKAT EKTSVSKKVL NLMENSEIGS
MDSIFTQDEA SINAQSNVFE GLYQLDEKDQ LIPAAAKEMP EISEDGKRYT IKLREDGKWS
NGDAVTANDF VFAWRKLANP KNQANYFFLL EGTILNGTAI TKEEKAPEEL GVKALDDYTL
EVTLEKPVPY FTSLLAFSPF FPQNEAFVKE KGQAYGTSSE MIVSNGPFLM KNWDQSAMSW
DFVRNPYYYD KEKVKSETIH FEVLKETNTV YNLYESGELD VAVLTGDFAK QNRDNPDYEA
IERSKVYSLR LNQKRNEKPS IFANENVRKA LAYALDKKSL VDNILADGSK EIYGYIPEKF
VYNPETNEDF RQEAGALVKT DAKKAKEYLD KAKAELNGDV AIELLSRDGD SDR
```

TABLE 1-continued

Nucleotide and Amino Acid Seqeuences of E. faecalis Genes.

EF030-3 (SEQ ID NO:115)
GAGAAAGCA
ACTGAGAAAA CCAGTGTCTC GAAAAAGTT TTAAATTTAA TGGAGAACTC GGAAATCGGT
TCAATGGATT CTATTTTTAC ACAAGATGAA GCCAGTATTA ACGCACAGTC CAATGTCTTT
GAAGGGTTAT ATCAATTGGA TGAAAAAGAT CAACTACATC CTGCTGCTGC TAAAGAGATG
CCAGAAATTT CTGAGGATGG CAAACGATAT ACCATTAAAC TAAGAGAAGA TGGCAAGTGG
TCCAATGGTG ATGCTGTAAC AGCCAATGAT TTCGTTTTTG CTTGGCGTAA ATTAGCGAAT
CCCAAAAACC AAGCCAATTA CTTTTTCTTG TTAGAAGGAA CGATTCTGAA CGGAACAGCT
ATTACAAAAG AGGAAAAAGC ACCAGAGGAA TTGGGTGTCA AAGCGCTTGA TGATTATACT
TTGGAGGTTA CTTTAGAAAA GCCTGTACCA TATTTTACGT CGTTATTGGC ATTTTCTCCA
TTTTTCCCAC AAAACGAAGC ATTCGTGAAA GAAAAAGGAC AAGCCTATGG CACTTCTAGT
GAAATGATTG TATCTAATGG TCCGTTTTTA ATGAAAAATT GGGATCAGTC AGCGATGTCG
TGGGATTTTG TGCGTAATCC CTACTATTAC GATAAAGAAA AAGTAAAATC AGAAACGATT
CATTTTGAAG TTCTTAAAGA AACCAATACC GTTTATAATT TGTACGAATC AGGTGAATTA
GATGTGGCTG TCTTAACAGG AGATTTTGCT AAACAAATC GAGACAACCC AGACTATGAA
GCAATCGAAC GGTCAAAAGT CTATTCCTTA CGTTTAAACC AAAAAAGAAA CGAAAAACCA
TCCATTTTTG CAAATGAGAA TGTCCGCAAA GCTTTAGCTT ATGCTTTGGA TAAAAAAAGT
TTAGTCGATA ATATTTTAGC AGATGGCTCA AAAGAAATTT ATGGGTACAT TCCAGAAAAA
TTTGTATATA ACCCAGAAAC GAATGAAGAT TTCGTCAAG AAGCAGGCGC TCTTGTCAAA
ACAGACGCCA AAAAAGCCAA AGAGTATTTA GATAAAGCAA AAGCAGAGCT AAACGGAGAT
GTAGCCATTG AACTTCTTTC AAGAGATGGT

EF030-4 (SEQ ID NO:116)
EKAT EKTSVSKKVL NLMENSEIGS
MDSIFTQDEA SINAQSNVFE GLYQLDEKDQ LIPAAAKEMP EISEDGKRYT IKLREDGKWS
NGDAVTANDF VFAWRKLANP KNQANYFFLL EGTILNGTAI TKEEKAPEEL GVKALDDYTL
EVTLEKPVPY FTSLLAFSPF FPQNEAFVKE KGQAYGTSSE MIVSNGPFLM KNWDQSAMSW
DFVRNPYYYD KEKVKSETIH FEVLKETNTV YNLYESGELD VAVLTGDFAK QNRDNPDYEA
IERSKVYSLR LNQKRNEKPS IFANENVRKA LAYALDKKSL VDNILADGSK EIYGYIPEKF
VYNPETNEDF RQEAGALVKT DAKKAKEYLD KAKAELNGDV AIELLSRDG

EF031-1 (SEQ ID NO:117)
TGAGAAATTA GTTATTTTAG AAAAATAAAA ACQATTTTGG AGGAAGATTT AAAAATGAAA
AAACGCGTAA TTTTAGGGAC ATTAGTCGCT GCAACGTTAT TAATGACTGC TTGTGGAAAC
AGCGAAGCAA CTACGAAAAG CGAGAGCAAA GGTGGAAGTA ATGCTTTAGT CGTTTCAACT
TTCGGATTAA GTGAAGATAT TGTCAAAAAA GACATTATCG CTCCATTTGA AAAAGAGAAT
GAAGCGAAAG TTACCTTAGA AGTAGGCAAT AGCGCAGACC GCTTTACGAA ATTAAAAAAT
AATCCCAATG CGGGAATTGA TGTCATTGAA TTAGCACAAG CAAATGCAGC ACAAGGTGGA
AAAGATGdGT TATTTGAAAA AATTACAGAA AAAGAAGTAC CTAATTTAAG TCAGTTAACG
CCGGGAGCAA AAGAGGTTTT TGAAAGTGGT GCTGGCGTAC AATCGCTGT AAACAGTATC
GGGATTGTTT ACAACAAAGA AAAATTAGGC AAAGAAATTA AAAACTGGGA TGACTTATGG
TCAGCTGATT TGAAAGGTAA AATTTCTGTT CCAGACGTTG CCACGACGGC AGGTCCTTTA
ATGTTATACG TTGCTAGTGA ACATGCTGGT CAAGATATTA CAAAAGATAA CGGGAAGGCC
GCTTTTGAAG CGATGAAAGA ATTAAAACCA AACGTTGTTA AAACGTATTC AAAATCGTCA
GACTTAGCNA ATATGTTCCA ATCTGGTGAA ATTGAAGCAG CTGTGGTTGC TGATTTTGCG
GTTGATATTA TTCAAGGCGC ACAGAAAACG TGA

EF0031-2 (SEQ ID NO:118)
MKK RVILGTLVAA TLLMTACGNS EATTKSESKG GSNALWSTF
GLSEDIVKKD IIAPFEKENE AKVTLEVGNS ADRFTKLKNN PNAGIDVIEL AQANAAQGGK
DGLFEKITEK EVPNLSQLTP GAKEVFESGA GVPIAVNSIG IVYNKEKLGK EIKNWDDLWS
ADLKGKISVP DVATTAGPLM LYVASEHAGQ DITKDNGKAA FEAMKELKPN WKTYSKSSD
LANMFQSGEI EAAVVADFAV DIIQGAQKT

EF031-3 (SEQ ID NO:119)
AA CTACGAAAAG CGAGAGCAAA GGTGGAAGTA ATGCTTTAGT CGTTTCAACT
TTCGGATTAA GTGAAGATAT TGTCAAAAAA GACATTATCG CTCCATTTGA AAAAGAGAAT
GAAGCGAAAG TTACCTTAGA AGTAGGCAAT AGCGCAGACC GCTTTACGAA ATTAAAAAAT
AATCCCAATG CGGGAATTGA TGTCATTGAA TTAGCACAAG CAAATGCAGC ACAAGGTGGA
AAAGATGGGT TATTTGAAAA AATTACAGAA AAAGAAGTAC CTAATTTAAG TCAGTTAACG
CCGGGAGCAA AAGAGGTTTT TGAAAGTGGT GCTGGCGTAC AATCGCTGT AAACAGTATC
GGGATTGTTT ACAACAAAGA AAAATTAGGC AAAGAAATTA AAAACTGGGA TGACTTATGG
TCAGCTGATT TGAAAGGTAA AATTTCTGTT CCAGACGTTG CCACGACGGC AGGTCCTTTA
ATGTTATACG TTGCTAGTGA ACATGCTGGT CAAGATATTA CAAAAGATAA CGGGAAGGCC
GCTTTTGAAG CGATGAAAGA ATTAAAACCA AACGTTGTTA AAACGTATTC AAAATCGTCA
GACTTAGCNA ATATGTTCCA ATCTGGTGAA ATTGAAGCAG CTGTGGTTGC TGATTTTGCG
GTTGATATTA TTCAAGGCGC ACAGAAAA

EF031-4 (SEQ ID NO:120)
TTKSESKG GSNALWSTF
GLSEDIVKKD IIAPFEKENE AKVTLEVGNS ADRFTKLKNN PNAGIDVIEL AQANAAQGGK
DGLFEKITEK FVPNLSQLTP GAKEVFESGA GVPIAVNSIG IVYNKEKLGK EIKNWDDLWS
ADLKGKISVP DVATTAGPLM LYVASEHAGQ DITKDNGKAA FEAMKELKPN VVKTYSKSSD
LANMFQSGEI EAAVVADFAV DIIQGAQK

EF032-1 (SEQ ID NO:121)
TGAATAAATT ATTTAGGAGG AATTATGATG AAAAAATTAA TTAGTTTAGG ATTGGTTTGT

TABLE 1-continued

Nucleotide and Amino Acid Seqeuences of *E. faecalis* Genes.

```
GTTTGTGGTA TTTCACTACT TACTGCTTGT NCGGGAAATA ATGATAATAA AGATACTGAA
AAGTCAACCA GTCAATCTAG CAGCACAGTT AAACAACCGA ATTCAAAAGA CTTTGTTGCG
TCAGGGGAAT ATTCAGTTGG AAAAGATATT GATCCTGGAG ATTACTATGC TGTATTAACT
CAACTAGATG ATAAATCGAG CATAGTTCTT ATTACCGTCA AATCAGGCGG AGAAAATAGT
AACCATGACT TATACGGAGT GGGAAACAAG AAAAAAGTAT CTCTTAAAAA GGGAGATACT
CTCACATTCG AAACTGCCGA CAAAGATTTT GTTGTTAGAT TTTTAAATGA AAAAGATTTT
CAAGAATATA TGAAAAATCC AGTATCNAGT ACTGAAACTA GCAAACANAA AACAGTAAAC
TCTGATGTTT CTAAAAGTAG TAGCCAAGAT AATAAACAAT CTGATGTATC TGAAAAAAAA
GAAGTAAGTA CTGAAGCGAA GTCTGATGTA GCTACTAATA CTTTACCGAG CGAAGATAAA
AATACTAATG ACATTACTAA GCTAGCAGAT GAGCCAACCT TAGAACAACA AACCGTCTTA
GATACTTTAG CTAAGCATCA ATTTAATGAT ATGTATCCTT ATAAAGGAAG CAAAATGCAT
TCAATTATCG GCGTCATCCC AACCATGGAC GCAAAAAGAT GGTAA

EF032-2 (SEQ ID NO:122)
MK KLISLGLVCV CGISLLTACX GNNDNKDTEK STSQSSSTVK QPNSKDFVAS
GEYSVGKDID PGDYYAVLTQ LDDKSSIVLI TVKSGGENSN HDLYGVGNKK KVSLKKGDTL
TFETADKDFV VRFLNEKDFQ EYMKNPVSST ETSKXKTVNS DVSKSSSQDN KQSDVSEKKE
VSTEAKSDVA TNTLPSEDKN TNDITKLADE PTLEQQTVLD TLAKHQFNDM YPYKGSKMHS
IIGVIPTMDA KRW

EF032-3 (SEQ ID NO:123)
TA ATGATAATAA AGATACTGAA
AAGTCAACCA GTCAATCTAG CAGCACAGTT AAACAACCGA ATTCAAAAGA CTTTGTTGCG
TCAGGGGAAT ATTCAGTTGG AAAAGATATT GATCCTGGAG ATTACTATGC TGTATTAACT
CAACTAGATG ATAAATCGAG CATAGTTCTT ATTACCGTCA AATCAGGCGG AGAAAATAGT
AACCATGACT TATACGGAGT GGGAAACAAG AAAAAAGTAT CTCTTAAAAA GGGAGATACT
CTCACATTCG AAACTGCCGA CAAAGATTTT GTTGTTAGAT TTTTAAATGA AAAAGATTTT
CAAGAATATA TGAAAAATCC AGTATCNAGT ACTGAAACTA GCAAACANAA AACAGTAAAC
TCTGATGTTT CTAAAAGTAG TAGCCAAGAT AATAAACAAT CTGATGTATC TGAAAAAAAA
GAAGTAAGTA CTGAAGCGAA GTCTGATGTA GCTACTAATA CTTTACCGAG CGAAGATAAA
AATACTAATG ACATTACTAA GCTAGCAGAT GAGCCAACCT TAGAACAACA AACCGTCTTA
GATACTTTAG CTAAGCATCA ATTTAATGAT ATGTATCCTT ATAAAGGAAG CAAAATGCAT
TCAATTATCG GCGTCATCCC AACCATGGAC GCAAAAAGAT GG

EF032-4 (SEQ ID NO:124)
NDNKDTEK STSQSSSTVK QPNSKDFVAS
GEYSVGKDID PGDYYAVLTQ LDDKSSIVLI TVKSGGENSN HDLYGVGNKK KVSLKKGDTL
TFETADKDFV VRFLNEKDFQ EYMKNPVSST ETSKXKTVNS DVSKSSSQDN KQSDVSEKKE
VSTEAKSDVA TNTLPSEDKN TNDITKLADE PTLEQQTVLD TLAKHQFNDM YPYKGSKMHS
IIGVIPTMDA KRW

EF033-1 (SEQ ID NO:125)
TGACTGCTTT TTTTCTATTG GAGAAAAAAG TGGTTTTTTT GTATTGTTTT GACGTTGAGA
CAAAGGAGGT TCATTTCAGA AAATTTTCCC CAAAATAAAA TAGACGAATG CGAGGATGAA
AAAATGAAAA AATTTACTTT AACAATGATG ACTTTAGGTT TAGTAGCAAC ACTTGGCTTA
GCAGGATGTG GTAAACAGGA AAAGAAAGCA ACTACCTCTT CTGAAAAAAC AGAAGTAACG
TTACCAACCA AAGACCGTAG CGGCAAAGAA ATTACTTTAC CCAAAGAAGC AACCAAAATT
ATTTCCCTAG TGCCATCAAC AACAGAAGTG ATTGAAGACT TAGGTAAAAC CGACCAATTA
ATCGCAGTTG ATACTCAAAG TAGTACAATG ATGACTGATT TAAAAAAATT ACCACAAATG
GATATGATGG CTGTCGATGC CGAAAAATTG ATTGCCTTGA AACCACAAAT TGTTTATGTG
AATGACATCA ATTTAGCTAG CTCAGAAAGT GTTTGGAAGC AAGTGGAAGA TGCTGGAATT
ACAGTCGTTA ATATCCCCAC TAGTACAAGC ATCAAAGCAA TCAAAGAAGA CGTCCAATTC
ATCGCTGATA GCTTATCTGA ACATGAAAAA GGACAAAAGT TAATCAAAAC AATGGATCAA
GAAATCGACG AGTAG

EF033-2 (SEQ ID NO:126)
MKKFTLTMMT LGLVATLGLA
GCGKQEKKAT TSSEKTEVTL PTKDRSGKEI TLPKEATKII SLVPSTTEVI EDLGKTDQLI
AVDTQSSTMM TDLKKLPQMD MMAVDAEKLI ALKPQIVVVN DINLASSESV WKQVEDAGIT
VVNIPTSTSI KAIKEDVQFI ADSLSEHEKG QKLIKTMDQE IDE

EF033-3 (SEQ ID NO:127)
CTCTT CTGAAAAAAC AGAAGTAACG
TTACCAACCA AAGACCGTAG CGGCAAAGAA ATTACTTTAC CCAAAGAAGC AACCAAAATT
ATTTCCCTAG TGCCATCAAC AACAGAAGTG ATTGAAGACT TAGGTAAAAC CGACCAATTA
ATCGCAGTTG ATACTCAAAG TAGTACAATG ATGACTGATT TAAAAAAATT ACCACAAATG
GATATGATGG CTGTCGATGC CGAAAAATTG ATTGCCTTGA AACCACAAAT TGTTTATGTG
AATGACATCA ATTTAGCTAG CTCAGAAAGT GTTTGGAAGC AAGTGGAAGA TGCTGGAATT
ACAGTCGTTA ATATCCCCAC TAGTACAAGC ATCAAAGCAA TCAAAGAAGA CGTCCAATTC
ATAGACATGA GCTTATCTGA ACATGAAAAA GGACAAAAGT TAATCAAAAC AATGGATCAA
GAAATCGACG AGTAG

EF033-4 (SEQ ID NO:128)
SSEKTEVTL PTKDRSGKEI TLPKEATKII SLVPSTTEVI EDLGKTDQLI
AVDTQSSTMM TDLKKLPQMD MMAVDAEKLI ALKPQIVVVN DINLASSESV WKQVEDAGIT
VVNIPTSTSI KAIKEDVQFI ADSLSEHEKG QKLIKTMDQE IDE
```

TABLE 1-continued

Nucleotide and Amino Acid Seqeuences of E. faecalis Genes.

EF034-1 (SEQ ID NO:129)
TAGGAGGGAG TAATCATGAA AAAAATCGGG TATTTTAGTT GTATTATTTT TTTCATGTTT
TTGGTAGGTT GTAGTAATAA CAAAAAAGAA AACGGCAATC TTTTGAATGC CAGTTCGTTT
CCTTTAATAC TCACCACGAT TATTGAAAAA GAAGAAGACC TAACGAAAGG TTCAATTTTT
TTCAACAAGG ATAAAACCAT GACGCTTGAA AAGAATATT TAGTTAATCC CAATAATGAA
GACACAAAAA AAACAAGTAG AACAGAAAAA AAGGTATATA AAAATATTAA AATACAAGAA
AATAAAGAGA GCTATGAAAT TATAGGTCAA TTGGACAAAA AAACGAAAAA AATAGAGTTT
AAAAAAGTTG ATGAAGGTAA ACGTATATCT GATGCAGAAG GTAATGTGTA TGGTGATTTT
GGTCGTAAAT AG

EF034-2 (SEQ ID NO:130)
MKKIGY FSCIIFFMFL VGCSNNKKEN GNLLNASSFP LILTTIIEKE EDLTKGSIFF
NKDKTMTLEK EYLVNPNNED TKKTSRTEKK VYKNIKIQEN KESYEIIGQL DKKTKKIEFK
KVDEGKRISD AEGNVYGDFG GK

EF034-3 (SEQ ID NO:131)
AGAA AACGGCAATC TTTTGAATGC CAGTTCGTTT
CCTTTAATAC TCACCACGAT TATTGAAAAA GAAGAAGACC TAACGAAAGG TTCAATTTTT
TTCAACAAGG ATAAAACCAT GACGCTTGAA AAAdAATATT TAGTTAATCC CAATAATGAA
GACACAAAAA AAACAAGTAG AACAGAAAAA AAGGTATATA AAAATATTAA AATACAAGAA
AATAAAGAGA GCTATGAAAT TATAGGTCAA TTGGACAAAA AAACGAAAAA AATAGAGTTT
AAAAAAGTTG ATGAAGGTAA ACGTATATCT GATGCAGAAG GTAATGTGTA TGGTGATTTT
GGTGGTAAAT AG

EF034-4 (SEQ ID NO:132)
KEN GNLLNASSFP LILTTIIEKE EDLTKGSIFF
NKDKTMTLEK EYLVNPNNED TKKTSRTEKK VYKNIKIQEN KESYEIIGQL DKKTKKIEFK
KVDEGKRISD AEGNVYGDFG GK

EF035-1 (SEQ ID NO:133)
TAAACGAGAG GTGAGTTTAT GAAAACAAAA ATCGGAAAAA CAGTTATCTT GTCAGCATTT
TTATTCACAA GTTTCCTTTT ACTGAGTGGT TGTACCTCGG CTGGCGAAGA GATGGAAAAA
ACAATTGATC GACAGAAAGA AAAAGTCGAT AAAACGGTCG ATAAGCAGAA ACATAAAAAT
GAAAATTCCA TGGAAAGTTA CGACGAAAAA GTTGACCGTT CTTTAGATAG TCAAGAAGAC
AAAATCGATA CTACTGAGTA A

EF035-2 (SEQ ID NO:134)
MKTKI GKTVILSAFL FTSFLLLSGC TSAGEEMEKT IDRQKEKVDK TVDKQKHKNE
NSMESYDEKV DRSLDSQEDK IDTTE

EF035-3 (SEQ ID NO:135)
GATGGAAAAA GAAAAA
ACAATTGATC GACAGAAAGA AAAAGTCGAT AAAACGGTCG ATAAGCAGAA ACATAAAAAT
GAAAATTCCA TGGAAAGTTA CGACGAAAAA GTTGACCGTT CTTTAGATAG TCAAGAAGAC
AAAATCGATA CTACTGAG

EF035-4 (SEQ ID NO:136)
MEKT IDRQKEKVDK TVDKQKHKNE
NSMESYDEKV DRSLDSQEDK IDTTE

EF036-1 (SEQ ID NO:137)
TAATTTTCAA GTCCTACATA TAATGGTAAA ATAGAATGGA TTGAAATTAA TTGGAGGAAT
AATGAATCGA TGAAAAAAAG ATTGCTATTA TTTATTGGTT TGGCAAGTAT ACTTACTTTG
ACAGGATGTG CAAAATGGAT TGATCGTGGT GAATCCATCA CAGCGGTAGG CTCATCAGCT
TTACAACCAT TAGTAGAGAC AGCGAGTGAG GAATATCAAA GCCAAAATCC GGGAAGATTT
ATTAATGTCC AAGGTGGCGG AAGCGGAACA GGTCTGAGTC AAGTCCAATC TGGCGCGGTA
GACATTGGTA ATTCTGATTT ATTTGCAGAA GAGAAAAAGG GCATCAAAGC GGAAGACTTA
ATTGATCATA AAGTTGCTGT CGTTGGGATT ACACCAATCG TTAACAAAAA TGTCGGTGTC
AAAGATATCT CAATGGAAAA TTTAAAGAAA AATCTTTTTAG GTGAAGTAAC AAACTGGAAA
GAACTTGGCG GGAAAGACCA AAAAATTGTT ATTTTGAATA GAGCGGCCGG TAGTGGTACG
CGTGCGACTT TTGAAAAGTG GGTCTTGGGA GATAAAACAG CCATTCGTGC GCAAGAACAA
GATTCCAGCG GCATGGTTCG TTCCATTGTT TCTGATACAC CAGGAGCGAT TAGTTATACC
GCATTTTCAT ATGTTACTGA TGAAGTAGCT ACGTTAAGTA TTGATGGTGT TCAGCCAACA
GATGAAAATG TAATGAACAA TAAATGGATT ATTTGGTCTT ATGAACACAT GTACACTCGT
AAAAATCCAA GTGATTTAAC CAAAGAGTTT TTAGACTTTA TGTTGTCAGA TGATATCCAA
GAACGTGTGA TTGGTCAATT AGGGTATATT CCTGTTTCGA AAATGGAAAT TGAACGGGAT
TGGCAAGGAA ATGTCATTAA ATAA

EF036-2 (SEQ ID NO:138)
MKKRLLLF IGLASILTLT GCAKWIDRGE SITAVGSSAL
QPLVETASEE YQSQNPGRFI NVQGGGSGTG LSQVQSGAVD IGNSDLFAEE KKGIKAEDLI
DHKVAVVGIT PIVNKNVGVK DISMENLKKI FLGEVTNWKE LGGKDQKIVI LNRAAGSGTR
ATFEKWVLGD KTAIRAQEQD SSGHVRSIVS DTPGAISYTA FSYVTDEVAT LSIDGVQPTD
ENVMNNKWII WSYEHMYTRK NPSDLTKEFL DFMLSDDIQE RVIGQLGYIP VSKMEIERDW
QGNVIK

EF036-3 (SEQ ID NO:139)

TABLE 1-continued

Nucleotide and Amino Acid Seqeuences of E. faecalis Genes.

```
GAT TGATCGTGGT GAATCCATCA CAGCGGTAGG CTCATCAGCT
TTACAACCAT TAGTAGAGAC AGCGAGTGAG GAATATCAAA GCCAAAATCC GGGAAGATTT
ATTAATGTCC AAGGTGGCGG AAGCGGAACA GGTCTGAGTC AAGTCCAATC TGGCGCGGTA
GACATTGGTA ATTCTGATTT ATTTGCAGAA GAGAAAAAGG GCATCAAAGC GGAAGACTTA
ATTGATCATA AAGTTGCTGT CGTTGGGATT ACACCAATCG TTAACAAAAA TGTCGGTGTC
AAAGATATCT CAATGGAAAA TTTAAAGAAA ATCTTTTTAG GTGAAGTAAC AAACTGGAAA
GAACTTGGCG GGAAAGACCA AAAAATTGTT ATTTTGAATA GAGCGGCCGG TAGTGGTACG
CGTGCGACTT TTGAAAAGTG GGTCTTGGGA GATAAAACAG CCATTCGTGC GCAAGAACAA
GATTCCAGCG GCATGGTTCG TTCCATTGTT TCTGATACAC CAGGAGCGAT TAGTTATACC
GCATTTTCAT ATGTTACTGA TGAAGTAGCT ACGTTAAGTA TTGATGGTGT TCAGCCAACA
GATGAAAATG TAATGAACAA TAAATGCATT ATTTGGTCTT ATGAACACAT GTACACTCGT
AAAAATCCAA GTGATTTAAC CAAAGAGTTT TTAGACTTTA TGTTGTCAGA TGATATCCAA
GAACGTGTGA TTGGTCAATT AGGGTATATT CCTGTTTCGA AAATGGAAAT TGAACGGGAT
TGGCAAGGAA ATGTCATTAA A

EF036-4 (SEQ ID NO:140)
IDRGE SITAVGSSAL
QPLVETASEE YQSQNPGRFI NVQGGGSGTG LSQVQSGAVD IGNSDLFAEE KKGIKAEDLI
DHKVAVVGIT PIVNKNVGVK DISMENLKKI FLGEVTNWKE LGGKDQKIVI LNRAAGSGTR
ATFEKWVLGD KTAIRAQEQD SSGMVRSIVS DTPGAISYTA FSYVTDEVAT LSIDCVQPTD
ENVMNNKWII WSYEHMYTRK NPSDLTKEFL DFMLSDDIQE RVIGQLGYIP VSKMEIERDW
QGNVIK

EF037-1 (SEQ ID NO:141)
TGAGTGTATG ATTACTCATT TCCCTTTGAA TCAGTTATGA TAAAGGAAGA AATAAATAAA
TTTTTTGGAG GGATTTTCAT GAAAATGTCT AAAGTACTCA CCACTGTTTT GACGGCAACT
GCTGCTCTTG TGTTGCTTAG TGCTTGTTCA TCTGATAAAA AAACAGATAG TAGTTCTAGT
AGCAAAGAAA CAGCTAATTC AAGTACAGAA GTAGTCTCTG GTGCTTCAAT TAGTGCCAAG
CCTGAAGAGC TCGAAATGGC GTTAAGTGAT AAAGGAAATT GGATTGTCGC AGCTACTGAC
AATGTCACTT TTGATAAAGA GGTAACAGTT GCTGGTACTT TCCATGATAA GGGGAAAGAT
TCCAACGATG TCTATCGTAA ATTAGCACTT TATTCCCAAG ATGATAATAA AAAAGTAACT
GCTGAATATG AAATCACGGT TCCTAAGCTA ATCGTTTCTT CTGAAAATTT CAACATCGTT
CACGGGACTG TCAAAGGTGA TATTGAGGTG AAAGCAAATG GCTTTACTTT AAATGGTACC
AAAGTTAATG GCAATATTAC TTTTGATAAA CAAGAATACA AAGATTCTGC TGACTTAGAA
AAAGATGGTG CCACTGTTAC TGGTGAAGTC ACCGTAGCCA ATAA

EF037-2 (SEQ ID NO:142)
MKMSK VLTTVLTATA ALVLLSACSS DKKTDSS$SS
KETANSSTEV VSGASISAKP EELEMALSDK GNWIVAATDN VTFDKEVTVA GTFHDKGKDS
NDVYRKLALY SQDDNKKVTA EYEITVPKLI VSSENFNIVH GTVKGDIEVK ANGFTLNGTK
VNGNITFDKQ EYKDSADLEK DGATVTGEVT VANN

EF037-3 (SEQ ID NO:143)
AACAGATAG TAGTTCTAGT
AGCAAAGAAA CAGCTAATTC AAGTACAGAA GTAGTCTCTG GTGCTTCAAT TAGTGCCAAG
CCTGAAGAGC TCGAAATGGC GTTAAGTGAT AAAGGAAATT GGATTGTCGC AGCTACTGAC
AATGTCACTT TTGATAAAGA GGTAACAGTT GCTGGTACTT TCCATGATAA GGGGAAAGAT
TCCAACGATG TCTATCGTAA ATTAGCACTT TATTCCCAAG ATGATAATAA AAAAGTAACT
GCTGAATATG AAATCACGGT TCCTAAGCTA ATCGTTTCTT CTGAAAATTT CAACATCGTT
CACGGGACTG TCAAAGGTGA TATTGAGGTG AAAGCAAATG GCTTTACTTT AAATGGTACC
AAAGTTAATG GCAATATTAC TTTTGATAAA CAAGAATACA AAGATTCTGC TGACTTAGAA
AAAGATGGTG CCACTGTTAC TGGTGAAGTC ACCGTAGCCA A

EF037-4 (SEQ ID NO:144)
TDSSSSS
KETANSSTEV VSGASISAKP EELEMALSDK GNWIVAATDN VTFDKEVTVA GTFHDKGKDS
NDVYRKLALY SQDDNKKVTA EYEITVPKLI VSSENFNIVH GTVKGDIEVK ANGFTLNGTK
VNGNITFDKQ EYKDSADLEK DGATVTGEVT VANN

EF038-1 (SEQ ID NO:145)
TAATGGCCAT TTCGTCTACT AATAAAGAGG ATGAAGCTAC TCAAATGGCG TTGGCAATGG
AACAAGGATC ATAAAAAAGG AGAAGTGAGC ATGAAAAAAG TACTACCTTT TATTGCCTTA
GTCGGCTTGT TATTGTTGTC AGGTTGTGGA ACAGATATGA AAAAGATATT GACTGCCGAT
GGTGGTAAAT GGGAACTAGA AAATAAAAGT CCAACTACTA CTTACACTTT TTTTGATGAT
GAAACTTTTT CGAGGTATAA TTCAAAAATT AGTGATAGTG GAACGTACTC TTACGATGAA
AATAATAAAA AACTCACTTT GGATATAAAA AATAAAGAAC AATTAATAAT GGAAAATGTT
GAATATAAAG ACGGTAAATT AAAAGGTGAA ATTGGAGGCG AGAAGGACTC TGATAAAAAA
TNGAATAAGA GGTGTCTTTG A

EF038-2 (SEQ ID NO:146)
M KLLKWRWQWN KDHKKGEVSM KKVLPFIALV GLLLLSGCGT DMKKILTADG
GKWELENKSP TTTYTFFDDE TFSRYNSKIS DSGTYSYDEN NKKLTLDIKN KEQLIMENVE
YKDGKLKGEI GGEKDSDKKX NKRCL

EF038-3 (SEQ ID NO:147)
TTGTGGA ACAGATATGA AAAAGATATT GACTGCCGAT
GGTGGTAAAT GGGAACTAGA AAATAAAAGT CCAACTACTA CTTACACTTT TTTTGATGAT
```

TABLE 1-continued

Nucleotide and Amino Acid Seqeuences of E. faecalis Genes.

```
GAAACTTTTT CGAGGTATAA TTCAAAAATT AGTGATAGTG GAACGTACTC TTACGATGAA
AATAATAAAA AACTCACTTT GGATATAAAA AATAAAGAAC AATTAATAAT GGAAAATGTT
GAATATAAAG ACGGTAAATT AAAAGGTGAA ATTGGAGGCG AGAAGGACTC TGATAAAAAA
TNGAATAAGA GGTGTCTTTG A

EF038-4 (SEQ ID NO:148)
CGT DMKKILTADG
GKWELENKSP TTTYTFFDDE TFSRYNSKIS DSGTYSYDEN NKKLTLDIKN KEQLIMENVE
YKDGKLKGEI GGEKDSDKKX NKRCL

EF039-1 (SEQ ID NO:149)
TAAATATATC AAAAAGAAAA AAGGGGATTA CCAACCATGA AAAAGAAAAA AGTTTTTAGT
GCGCTTACCT TATTAACCTT TAGTACGTTG TTGATTGCAG GCTGTGCTGG CGGAGCCAAC
TCTGCAACAG ATAAATCAAG TGCAGCTAGC TCAAGCACTG CAGTCTCTAG TTCAGCAGAA
GCAGCTAAAG AGCAATCAAA AGGACAAGAA TTAACAGAAA TTTTATCCAG TACTGATTGG
CAAGGCACAA AAGTTTACGA CAAAAATNAT AATAATTTAA CAGCAGAAAA TGCTAATTTT
ATTGGTTTAG CAAAATATGA TGGTGAAACA GGTTTTTATG AATTTTTCGA CAAAGAAACA
GGTGAAACCC GTGGCGATGA AGGCACATTC TTTGTGACAG ACGATGGCGA AAAGCGTATC
TTAATTTCGG ATACACAAAA CTATCAAGCG GTGGTCGATT TAACGGAAGT GACGAAAGAT
AAATTTACCT ATAAGCGAAT GGGTAAAGAT AAAGACGGGA AGATGTAGA AGTCTTTGTA
GAACATATCC CTTATTCTGA CGAGAAATTA ACCTTTACGA ACGGCCGTAA AGATTTAGAA
ACAGAAACTG GCAAGATTGT TACCAATGAA CCTGGGGATG ACATTTTAGG GGCCACATTA
TGGAATGGCA CGAAAGTTTT AGATGAAGAC GGTAACGATG TTACTGAAGC AAATAAAATG
TTTATTAGTT TAGCGAAATT TGATAATAAA ACAAGTAAAT ATGAATTCTT TGATTTAGAA
ACGGGTAAAA CACGTGGAGA TTTTGGTTAC TTCCAAGTAA TTGATAATAA CAAAATCCGT
GCTCACGTTT CAATTGGTGA CAATAAATAT GGAGCTGCAT TAGAATTAAC AGAATTAAAT
GATAAACGTT TTACGTATAC ACGAATGGGT AAAGACAACA ATGGCAAAGA AATTAAAGTC
TTTGTAGAAC ATGAACCATA TGAAGGAGAC TTTACGCCAG ACTTCACGTT CTAA

EF039-2 (SEQ ID NO:150)
MKKKKVFSA LTLLTFSTLL IAGCAGGANS ATDKSSAASS STAVSSSAEA
AKEQSKGQEL TEILSSTDWQ GTKVYDKNXN NLTAENANFI GLAKYDGETG FYEFFDKETG
ETRGDEGTFF VTDDGEKRIL ISDTQNYQAV VDLTEVTKDK FTYKRMGKDK DGKDVEVFVE
HIPYSDEKLT FTNGRKDLET ETGKIVTNEP GDDILGATLW NGTKVLDEDG NDVTEANKMF
ISLAKFDNKT SKYEFFDLET GKTRGDFGYF QVIDNNKIRA HVSIGDNKYG AALELTELND
KRFTYTSMGK DNNGKEIKVF VEHEPYEGDF TPDFTF

EF039-3 (SEQ ID NO:151)
TGCAACAG ATAAATCAAG TGCAGCTAGC TCAAGCACTG CAGTCTCTAG TTCAGCAGAA
GCAGCTAAAG AGCAATCAAA AGGACAAGAA TTAACAGAAA TTTTATCCAG TACTGATTGG
CAAGGCACAA AAGTTTACGA CAAAAATNAT AATAATTTAA CAGCAGAAAA TGCTAATTTT
ATTGGTTTAG CAAAATATGA TGGTGAAACA GGTTTTTATG AATTTTTCGA CAAAGAAACA
GGTGAAACCC GTGGCGATGA AGGCACATTC TTTGTGACAG ACGATGGCGA AAAGCGTATC
TTAATTTCGG ATACACAAAA CTATCAAGCG GTGGTCGATT TAACGGAAGT GACGAAAGAT
AAATTTACCT ATAAGCGAAT GGGTAAAGAT AAAGACGGGA AGATGTAGA AGTCTTTGTA
GAACATATCC CTTATTCTGA CGAGAAATTA ACCTTTACGA ACGGCCGTAA AGATTTAGAA
ACAGAAACTG GCAAGATTGT TACCAATGAA CCTGGGGATG ACATTTTAGG GGCCACATTA
TGGAATGGCA CGAAAGTTTT AGATGAAGAC GGTAACGATG TTACTGAAGC AAATAAAATG
TTTATTAGTT TAGCGAAATT TGATAATAAA ACAAGTAAAT ATGAATTCTT TGATTTAGAA
ACGGGTAAAA CACGTGGAGA TTTTGGTTAC TTCCAAGTAA TTGATAATAA CAAAATCCGT
GCTCACGTTT CAATTGGTGA CAATAAATAT GGAGCTGCAT TAGAATTAAC AGAATTAAAT
GATAAACGTT TTACGTATAC ACGAATGGGT AAAGACAACA ATGGCAAAGA AATTAAAGTC
TTTGTAGAAC ATGAACCATA TGAAGGAGAC TTTACGCCAG ACTTCACGTT CTAA

EF039-4 (SEQ ID NO:152)
ATDKSSAASS STAVSSSAEA
AKEQSKGQEL TEILSSTDWQ GTKVYDKNXN NLTAENANFI GLAKYDGETG FYEFFDKETG
ETRGDEGTFF VTDDGEKRIL ISDTQNYQAV VDLTEVTKDK FTYKRMGKDK DGKDVEVFVE
HIPYSDEKLT FTNGRKDLET ETGKIVTNEP GDDILGATLW NGTKVLDEDG NDVTEANKMF
ISLAKFDNKT SKYEFFDLET GKTRGDFGYF QVTDNNKIRA HVSIGDNKYG AALELTELND
KRFTYTRMGK DNNGKEIKVF VEHEPYEGDF TPDFTF

EF040-1 (SEQ ID NO:153)
TAGATTAGAA CCACTGGAGA AAAATCTCAT ATTTCTCTCG AGGAAAGGAA GTTGAGCACA
ATGAACAAAA AAATTTTAAT GGGGCTATTA AGTGTCGTGA CCATTCCATT ACTTGCTGCG
TGTCAAGGAG GAGAAACACC TTCCGCAGCG TCAAAAAATA GTCAAACGGT GACTACTCAA
AGTAGTGCAA AAACTGAAAG CACCAGTACA ACCCGTCGG TAGCTCAAAC AACATCAAAA
GAGGAAGTGA AAGAACCGAT GAAGACCTAT GAAGTGGGTG CGCTTTTAGA AGCAGCCAAT
CAACGAGATA CGAAGAAGGT CAAGGAAATT TTACAAGATA CTACTTATCA AGTGGATGAA
GTCGACACAG AAGGCAACAC ACCGCTCAAT ATCGCTGTTC ACAATAATGA CATTGAGATT
GCAAAAGCGT TGATTGATCG GGGTGCCGAT ATTAATCTGC AAAACAGCAT TAGTGATAGT
CCCTATCTTT ATGCGGGAGC GCAAGGACGT ACGGAGATTT TAGCGTATAT GTTAAAACAT
GCGACCCCAG ATTTAAATAA GCATAACCGT TACGGTGGCA ATGCGTTAAT TCCGGCAGCT
GAAAAAGGAC ATATTGACAA TGTGAAGCTC TTGTTAGAAG ATGGACGAGA AGACATAGAT
TTCCAAAATG ACTTTGGCTA TACAGCATTG ATTGAGGCAG TGGGGTTACG TGAAGGGAAC
CAACTTTACC AAGATATTGT AAAATTGTTA ATGGAAAATG GTGCGGATCA ATCCATTAAA
GACAATTCTG GTCGAACAGC AATGGACTAT GCCAATCAAA AAGGTTATAC GGAAATTAGT
```

TABLE 1-continued

Nucleotide and Amino Acid Seqeuences of E. faecalis Genes.

AAAATTTTAG CACAGTACAA CTAA

EF040-2 (SEQ ID NO:154)
M NKKILMGLLS WTIPLLAAC QGGETPSAAS KNSQTVTTQS
SAKTESTSTT RSVAQTTSKE EVKEPMKTYE VGALLEAANQ RDTKKVKEIL QDTTYQVDEV
DTEGNTPLNI AVHNNDIEIA KALIDRGADI NLQNSISDSP YLYAGAQGRT EILAYMLKHA
TPDLNKHNRY GGNALIPAAE KGHIDNVKLL LEDGREDIDF QNDFGYTALI EAVGLREGNQ
LYQDIVKLLM ENGADQSIKD NSGRTAMDYA NQKGYTEISK ILAQYN

EF040-3 (SEQ ID NO:155)
AGCG TCAAAAAATA GTCAAACGGT GACTACTCAA
AGTAGTGCAA AAACTGAAAG CACCAGTACA ACCCGTTCGG TAGCTCAAAC AACATCAAAA
GAGGAAGTGA AGAACCGAT GAAGACCTAT GAAGTGGTG CGCTTTTAGA AGCAGCCAAT
CAACGAGATA CGAAGAAGGT CAAGGAAATT TTACAAGATA CTACTTATCA AGTGGATGAA
GTCGACACAG AAGGCAACAC ACCGCTCAAT ATCGCTGTTC ACAATAATGA CATTGAGATT
GCAAAAGCGT TGATTGATCG GGGTGCCGAT ATTAATCTGC AAAACAGCAT TAGTGATAGT
CCCTATCTTT ATGCGGGAGC GCAAGGACGT ACGGAGATTT TAGCGTATAT GTTAAAACAT
GCGACCCCAG ATTTAAATAA GCATAACCGT TACGGTGGCA ATGCGTTAAT TCCGGCAGCT
GAAAAAGGAC ATATTGACAA TGTGAAGCTC TTGTTAGAAG ATGGACGAGA AGACATAGAT
TTCCAAAATG ACTTTGGCTA TACAGCATTG ATTGAGGCAG TGGGGTTACG TGAAGGGAAC
CAACTTTACC AAGATATTGT AAAATTGTTA ATGGAAAATG GTGCGGATCA ATCCATTAAA
GACAATTCTG GTCGAACAGC AATGGACTAT GCCAATCAAA AAGGTTATAC GGAAATTAGT
AAAATTTTAG CACAGTACAA C

EF040-4 (SEQ ID NO:156)
AS KNSQTVTTQS
SAKTESTSTT RSVAQTTSKE EVKEPMKTYE VGALLEAANQ RDTKKVKEIL QDTTYQVDEV
DTEGNTPLNI AVHNNDIEIA KALIDRGADI NLQNSISDSP YLYAGAQGRT EILAYMLKHA
TPDLNKHNRY GGNALIPAAE KGHIDNVKLL LEDGREDIDF QNDFGYTALI EAVGLREGNQ
LYQDIVKLLM ENGADQSIKD NSGRTAMDYA NQKGYTEISK ILAQYN

EF041-1 (SEQ ID NO:157)
TAATTATTAA NTTCTGATTT TTCAGAAAAT ACAGATTGCA TTATTTTAGG AGGCAACACT
ATGAAATTGA AAAAGTCATT AACATTCGGT GTGATTACAT TATTTAGCGT AACAACTTTA
GCGGCTTGTG GAGGCGGCGG AACGTCAGAT AGCTCAAGCG CGTCTGGTGG CGGTAAGGCA
AGTGGCGAAC AAGTTTTACG TGTCACAGAA CAACAAGAAA TGCCAACAGC TGATTTATCA
CTAGCAACAG NCAGAATTAG TTTTATTGCA TTAAATAATG TATATGAAGG AATTTATCGT
TTAGACAAAG ATAACAAAGT CCAACCTGCA GGTGCAGCGG AAAAAGCAGA AGTTTCTGAA
GATGGACTAA CATACAAAAT TAAATTAAAT AAAGATGCAA AATGGTCAGA CGGTAAACCA
GTGACTGCTA ATGACTATGT TTACGGATGG CAACGAACAG TTGATCCAGC GACAGCTTCT
GAATATGCTT ATCTGTATGC CTCTGTAAAA AATGGTGATG CCATTGCTAA AGGGGAAAAA
GATAAATCAG AATTAGGAAT TAAAGCAGTC AGTGATACAG AATTAGAAAT CACTTTAGAA
AAAGCAACAC CATACTTTGA TTACTTATTA GCTTTCCCAT CATTCTTCCC GCAACGTCAA
GACATTGTGG AAAAATATGG TAAAAATTAT GCATCAAACA GCGAAAGTGC TGTCTACAAT
GGTCCATTCG TCTTAGACGG CTTTGATGGT CCTGGTACAG ATACAAAATG GTCATTCAAG
AAAAACGATC AATATTGGGA TAAAGATACT GTGAAACTGG ACTCAGTAGA TGTGAATGTC
GTGAAAGAAT CACCAACCGC GTTGAACTTG TTCCAAGATG GACAAACAGA CGATGTCGTT
CTTTCTGGTG AATTAGCCCA ACAAATGGCC AATGACCCAG CTTTTGTTAG TCAAAAAGAA
GCATCAACAC AATATATGGA ACTAAATCAA CGTGATGAAA AATCACCATT TAGAAATGCG
AACTTACGTA AAGCAATTTC TTACTCAATC GACCGTAAAG CGTTAGTTGA ATCAATCCTT
AGGGGATGG

EF041-2 (SEQ ID NO:158)
M KLKKSLTFGV ITLFSVTTLA ACGGGGTSDS SSASGGGKAS
GEQVLRVTEQ QEMPTADLSL ATXRISFIAL NNVYEGIYRL DKDNKVQPAG AAEKAEVSED
GLTYKIKLNK DAKWSDGKPV TANDYVYGWQ RTVDPATASE YAYLYASVKN GDAIAKGEKD
KSELGIKAVS DTELEITLEK ATPYFDYLLA FPSFFPQRQD IVEKYGKNYA SNSESAVYNG
PFVLDGFDGP GTDTKWSFKK NDQYWDKDTV KLDSVDVNVV KESPTALNLF QDGQTDDVVL
SGELAQQMAN DPAFVSQKEA STQYMELNQR DEKSPFRNAN LRKAISYSID RKALVESILR
GW

EF041-3 (SEQ ID NO:159)
TTGTG GAGGCGGCGG AACGTCAGAT AGCTCAAGCG CGTCTGGTGG CGGTAAGGCA
AGTGGCGAAC AAGTTTTACG TGTCACAGAA CAACAAGAAA TGCCAACAGC TGATTTATCA
CTAGCAACAG NCAGAATTAG TTTTATTGCA TTAAATAATG TATATGAAGG AATTTATCGT
TTAGACAAAG ATAACAAAGT CCAACCTGCA GGTGCAGCGG AAAAAGCAGA AGTTTCTGAA
GATGGACTAA CATACAAAAT TAAATTAAAT AAAGATGCAA AATGGTCAGA CGGTAAACCA
GTGACTGCTA ATGACTATGT TTACGGATGG CAACGAACAG TTGATCCAGC GACAGCTTCT
GAATATGCTT ATCTGTATGC CTCTGTAAAA AATGGTGATG CCATTGCTAA AGGGGAAAAA
GATAAATCAG AATTAGGAAT TAAAGCAGTC AGTGATACAG AATTAGAAAT CACTTTAGAA
AAAGCAACAC CATACTTTGA TTACTTATTA GCTTTCCCAT CATTCTTCCC GCAACGTCAA
GACATTGTGG AAAAATATGG TAAAAATTAT GCATCAAACA GCGAAAGTGC TGTCTACAAT
GGTCCATTCG TCTTAGACGG CTTTGATGGT CCTGGTACAG ATACAAAATG GTCATTCAAG
AAAAACGATC AATATTGGGA TAAAGATACT GTGAAACTGG ACTCAGTAGA TGTGAATGTC
GTGAAAGAAT CACCAACCGC GTTGAACTTG TTCCAAGATG GACAAACAGA CGATGTCGTT
CTTTCTGGTG AATTAGCCCA ACAAATGGCC AATGACCCAG CTTTTGTTAG TCAAAAAGAA
GCATCAACAC AATATATGGA ACTAAATCAA CGTGATGAAA AATCACCATT TAGAAATGCG

TABLE 1-continued

Nucleotide and Amino Acid Seqeuences of E. faecalis Genes.

AACTTACGTA AAGCAATTTC TTACTCAATC GACCGTAAAG CGTTAGTTGA ATCAATCCTT
AGGGGATGG

EF041-4 (SEQ ID NO:160)
CGGGGTSDS SSASGGGKAS
GEQVLRVTEQ QEMPTADLSL ATXRISFIAL NNVYEGIYRL DKDNKVQPAG AAEKAEVSED
GLTYKIKLNK DAKWSDGKPV TANDYVYGWQ RTVDPATASE YAYLYASVKN GDAIAKGEKD
KSELGIKAVS DTELEITLEK ATPYFDYLLA FPSFFPQRQD IVEKYGKNYA SNSESAVYNG
PFVLDGFDGP GTDTKWSFKK NDQYWDKDTV KLDSVDVNVV KESPTALNLF QDGQTDDVVL
SGELAQQMAN DPAFVSQKEA STQYMELNQR DEKSPFRNAN LRKAISYSID RKALVESILR
GW

EF044-1 (SEQ ID NO:161)
TAAGATAAAA TTAGTTATAG CGTCTATAGG AGGAATAGTA TGAAAAAATT AGTTTGTGTT
ATTTTAGTTA TTTTTTTAAC AGGTTGTAGT TCTCAAAAAG CGAATGAACC TAAAAAACAA
GAAAATTCTA CCAATCATAC AACATCAATA AAAAGCAGTA CTAATCATTA CAGTTCTAGC
ATAGAAACAA GCTCTAATCC TAAACTAAAA GAAACTTCAG AAAGTGCCAG CACCACTCAA
ACTTCGTCAA AGTCGAAAAA TGAAGTATCT ACAAATGTCG AAGAAGCAAA TTCTTTAGAA
GCAACACCTT ATGCTGTCGA TCTTAGTAGC TTAAACAATC CACTCGTATT TAATTTTAAA
GGAATGAATG TGCCAACTTC AATTACGTTA GAGAACTTAA ATTCAACACC AACTGCTACC
TTCCGAACTA AATTGTTTGG GGCTGAAAAT GGTCAAGTGA AAGAAGCCAT TAATAAATAT
GAGCTATCTA TAAATACAAT TCCTACAAAA GAGATTAGAA TATTTTCAGC GGCCGATAAC
AGTATTCGCA CCGTTAAAGT AAATACAGAA TTAATTTTAG GAACTAATAT TTCTTCAAAC
GATGAACAAA ATAGATCGGG CACTTTATAC TTATTCAACA ATAAAAATGG TTCGATATCT
TTAATCACTC CTAACTACGC TGGCAATGTT ACGGATGATC AAAAAGACGT TATGCTAGAA
GTAATTCAAT AA

EF044-2 (SEQ ID NO:162)
MKKLVCVI LVIFLTGCSS QKANEPKKQE NSTNHTTSIK SSTNHYSSSI
ETSSNNKLKE TSESASTTQT SSKSKNEVST NVEEANSLEA TPYAVDLSSL NNPLVFNFKG
MNVPTSITLE NLNSTPTATF RTKLFGAENG QVKEAINKYE LSINTIPTKE IRIFSAADNS
IRTVKVNTEL ILGTNISSND EQNRSGTLYL FNNKNGSISL ITPNYAGNVT DDQKDVMLEV
IQ

EF044-3 (SEQ ID NO:163)
TTGTAGT TCTCAAAAAG CGAATGAACC TAAAAAACAA
GAAAATTCTA CCAATCATAC AACATCAATA AAAAGCAGTA CTAATCATTA CAGTTCTAGC
ATAGAAACAA GCTCTAATAA TAAACTAAAA GAAACTTCAG AAAGTGCCAG CACCACTCAA
ACTTCGTCAA AGTCGAAAAA TGAAGTATCT ACAAATGTCG AAGAAGCAAA TTCTTTAGAA
GCAACACCTT ATGCTGTCGA TCTTAGTAGC TTAAACAATC CACTCGTATT TAATTTTAAA
GGAATGAATG TGCCAACTTC AATTACGTTA GAGAACTTAA ATTCAACACC AACTGCTACC
TTCCGAACTA AATTGTTTGG GGCTGAAAAT GGTCAAGTGA AAGAAGCCAT TAATAAATAT
GAGCTATCTA TAAATACAAT TCCTACAAAA GAGATTAGAA TATTTTCAGC GGCCGATAAC
AGTATTCGCA CCGTTAAAGT AAATACAGAA TTAATTTTAG GAACTAATAT TTCTTCAAAC
GATGAACAAA ATAGATCGGG CACTTTATAC TTATTCAACA ATAAAAATGG TTCGATATCT
TTAATCACTC CTAACTACGC TGGCAATGTT ACGGATGATC AAAAAGACGT TATGCTAGAA
GTAATTCAA

EF044-4 (SEQ ID NO:164)
CSS QKANEPKKQE NSTNHTTSIK SSTNHYSSSI
ETSSNNKLKE TSESASTTQT SSKSKNEVST NVEEANSLEA TPYAVDLSSL NNPLVFNFKG
MNVPTSITLE NLNSTPTATF RTKLFGAENG QVKEAINKYE LSINTIPTKE IRIFSAADNS
IRTVKVNTEL ILGTNISSND EQNRSGTLYL FNNKNGSISL ITPNYAGNVT DDQKDVMLEV
IQ

EF045-1 (SEQ ID NO:165)
TAGCCAAAAA ATGAGGGAGG AAAAGAGATG AACAAGAAAC GGATTTTAGG TGCAATCACG
TTAGCTTCTG TGTTAGTATT CGGGTTAGCT GCATGTGGTG GCGGCAATAA AGGCGGGGGC
AATAAAGCAA CGGAAACAGA AGACATTTCA AAAATGCCAA TCGCTGTTAA AAATGATAAA
AAAGCAATTG ATGGCGGTAC ATTAGATGTC GCTGTAGTTA TGGATACACA ATTCCAAGGA
CTTTTCCAGC AAGAATTTTA TCAAGAQAAC TATGATGCAC AATACATGCT TCCAACGGTA
CAGCCATTAT TTAACAATGA TGCAGACTTT AAGATTGTCG ATGGGGGTCC TGCGGATCTG
AAATTAGATG AAGATGCCAA TACAGCAACC ATTAAATTAC GTGACAATTT GAAATGGTCT
GACGGTAAAG ATGTGACAGC CGATGACGTG ATTTTCTCTT ATGAAGTCAT TGGTCATAAA
GACTATACAG GGATTCGTTA TGATGATAAC TTTACGAATA TTGTTGGCAT GGAAGACTAC
CATGATGGTA AATCGCCAAC CATTTCTGGC ATAGAAAAAG TCAATGATAA AGAAGTTAAA
ATCACTTATA AAGAAGTTCA CCCAGGAATG CAACAATTGA GTGGCGGTGT TTGGGGCTCA
GTTTTACCAA AACATGCCTT TGAAGGAATT GCTGTTAAAG ACATGGAATC AAGCGATGCA
GTTCGTAAAA ACCCTGTGAC TATTGGACCA TACTACATGA GTAATATTGT GACAGGTGAA
TCTGTTGAAT ACCTACCAAA TGAGCATTAC TACGGTGGTA AACCTAAATT AGATAAATTA
GTGTTCAAAT CTGTTCCTTC TGCGAGCATT GTAGAAGCGA TGAAAGCGAA ACAATACGAT
ATTGCATTAT CAATGCCAAC AGATACGTAT CCAACATACA AGATACTGA AGGGTATCAA
ATCTTAGGAC GTCCCGAACA AGCCTACACG TATATTGGCT TTAAAATGGG TACGTTTGAC
AAAGAAACAA ATACAGTGAA ATACAATCCA AAAGCTAAAA TGGCAGATAA AGCTTACGT
CAAGCCATGG GCTATGCAAT TGACAATGAT GCAGTCGGCC AAAAATTCTA CAACGGCTTA
CGAACAGGGG CAACAACGTT AATCCCACCA GTCTTCAAGA GCTTGCATGA TAGCGAAGCG
AAAGGCTATA CGCTTGATTT AGACAAAGCG AAAAAATTAT TAGACGATGC TGGTTATAAA

TABLE 1-continued

Nucleotide and Amino Acid Seqeuences of *E. faecalis* Genes.

```
GACGTAGACG GCGATGGCAT TCGCGAAGAC AAAGAAGGCA AACCACTAGA AATCAAGTTT
GCTTCAATGT CAGGCGGCGA AACTGCACAA CCACTTGCTG ATTACTATGT CCAACAATGG
AAAGAAATTG GCTTAAACGT AACGTATACA ACAGGACGCT TAATTGATTT CCAAGCATTC
TATGATAAAT TGAAAAATGA TGACCCAGAA GTAGATATCT ATCAAGGCGC GTGGGGCACA
GGTTCAGATC CTTCACCAAC CGGCTTATAT GGTCCAAACT CAGCCTTTAA CTATACACGT
TTTGAGTCAG AAGAAAATAC TAAATTACTT GATGCGATTG ATTCAAAAGC ATCATTTGAT
GAAGAAAAAC GTAAAAAAGC CTTCTACGAT TGGCAAGAGT ATGCCATTGA TGAAGCGTTT
GTAATCCCAA CGCTTTACAG AAATGAAGTC TTGCCTGTCA ACGACCGTGT AGTTGACTTT
ACTTGGGCAG TTGATACGAA AGATAATCCA TGGGCAACGG TGGGTGTCAC AGCAGACTCA
CGGAAATAA

EF045-2 (SEQ ID NO:166)
MN KKRILGAITL ASVLVFGLAA CGGGNKGGGN KATETEDISK MPIAVKNDKK
AIDGGTLDVA VVMDTQFQGL FQQEFYQDNY DAQYMLPTVQ PLFNNDADFK IVDGGPADLK
LDEDANTATI KLRDNLKWSD GKDVTADDVI FSYEVIGHKD YTGIRYDDNF TNIVGMEDYH
DGKSPTISGI EKVNDKEVKI TYKEVHPGMQ QLGGGVWGSV LPKHAFEGIA VKDMESSDAV
RKNPVTIGPY YMSNIVTGES VEYLPNEHYY GGKPKLDKLV FKSVPSASIV EAMKAKQYDI
ALSMPTDTYP TYKDTEGYQI LGRPEQAYTY IGFKMGTFDK ETNTVKYNPK AKMADKSLRQ
AMGYAIDNDA VGQKFYNGLR TGATTLIPPV FKSLHDSEAK GYTLDLDKAK KLLDDAGYKD
VDGDGIREDK EGKPLEIKFA SMSGGETAQP LADYYVQQWK EIGLNVTYTT GRLIDFQAFY
DKLKNDDPEV DIYQGAWGTG SDPSPTGLYG PNSAFNYTRF ESEENTKLLD AIDSKASFDE
EKRKKAFYDW QEYAIDEAFV IPTLYRNEVL PVNDRVVDFT WAVDTKDNPW ATVGVTADSR
K

EF045-3 (SEQ ID NO:167)
ATGTGGTG GCGGCAATAA AGGCGGGGC
AATAAAGCAA CGGAAACAGA AGACATTTCA AAAATGCCAA TCGCTGTTAA AAATGATAAA
AAAGCAATTG ATGGCGGTAC ATTAGATGTC GCTGTAGTTA TGGATACACA ATTCCAAGGA
CTTTTCCAGC AAGAATTTTA TCAAGACAAC TATGATGCAC AATACATGCT TCCAACGGTA
CAGCCATTAT TTAACAATGA TGCAGACTTT AAGATTGTCG ATGGGGGTCC TGCGGATCTG
AAATTAGATG AAGATGCCAA TACAGCAACC ATTAAATTAC GTGACAATTT GAAATGGTCT
GACGGTAAAG ATGTGACAGC CGATGACGTG ATTTTCTCTT ATGAAGTCAT TGGTCATAAA
GACTATACAG GGATTCGTTA TGATGATAAC TTTACGAATA TTGTTGGCAT GGAAGACTAC
CATGATGGTA AATCGCCAAC CATTTCTGGC ATAGAAAAAG TCAATGATAA AGAAGTTAAA
ATCACTTATA AAGAAGTTCA CCCAGGAATG CAACAATTAG GTGGCGGTGT TTGGGGCTCA
GTTTTACCAA AACATGCCTT TGAAGGAATT GCTGTTAAAG ACATGGAATC AAGCGATGCA
GTTCGTAAAA ACCCTGTGAC TATTGGACCA TACTACATGA GTAATATTGT GACAGGTGAA
TCTGTTGAAT ACCTACCAAA TGAGCATTAC TACGGTGGTA AACCTAAATT AGATAAATTA
GTGTTCAAAT CTGTTCCTTC TGCGAGCATT GTAGAAGCGA TGAAAGCGAA ACAATACGAT
ATTGCATTAT CAATGCCAAC AGATACGTAT CCAACATACA AAGATACTGA AGGGTATCAA
ATCTTAGGAC GTCCCGAACA AGCCTACACG TATATTGGCT TTAAAATGGG TACGTTTGAC
AAAGAAACAA ATACAGTGAA ATACAATCCA AAAGCTAAAA TGGCAGATAA AAGCTTACGT
CAAGCCATGG GCTATGCAAT TGACAATGAT GCAGTCGGCC AAAAAATTCTA CAACGGCTTA
CGAACAGGGG CAACAACGTT AATCCCACCA GTCTTCAAGA GCTTGCATGA TAGCGAAGCG
AAAGGCTATA CGCTTGATTT AGACAAAGCG AAAAAATTAT TAGACGATGC TGGTTATAAA
GACGTAGACG GCGATGGCAT TCGCGAAGAC AAAGAAGGCA AACCACTAGA AATCAAGTTT
GCTTCAATGT CAGGCGGCGA AACTGCACAA CCACTTGCTG ATTACTATGT CCAACAATGG
AAAGAAATTG GCTTAAACGT AACGTATACA ACAGGACGCT TAATTGATTT CCAAGCATTC
TATGATAAAT TGAAAAATGA TGACCCAGAA GTAGATATCT ATCAAGGCGC GTGGGGCACA
GGTTCAGATC CTTCACCAAC CGGCTTATAT GGTCCAAACT CAGCCTTTAA CTATACACGT
TTTGAGTCAG AAGAAAATAC TAAATTACTT GATGCGATTG ATTCAAAAGC ATCATTTGAT
GAAGAAAAAC GTAAAAAAGC CTTCTACGAT TGGCAAGAGT ATGCCATTGA TGAAGCGTTT
GTAATCCCAA CGCTTTACAG AAATGAAGTC TTGCCTGTCA ACGACCGTGT AGTTGACTTT
ACTTGGGCAG TTGATACGAA AGATAATCCA TGGGCAACGG TGGGTGTCAC AGCAGACTCA
CGGAAA

EF045-4 (SEQ ID NO:168)
CGGGNKGGGN KATETEDISK MPIAVKNDKK
AIDGGTLDVA WMDTQFQGL FQQEFYQDNY DAQYMLPTVQ PLFNNDADFK IVDGGPADLK
LDEDANTATI KLRDNLKWSD GKDVTADDVI FSYEVIGHKD YTGIRYDDNF TNIVGMEDYH
DGKSPTISGI EKVNDKEVKI TYKEVHPGMQ QLGGGVWGSV LPKHAFEGIA VKDMESSDAV
RKNPVTIGPY YMSNIVTGES VEYLPNEHYY GGKPKLDKLV FKSVPSASIV EAMKAKQYDI
ALSMPTDTYP TYKDTEGYQI LGRPEQAYTY IGFKMGTFDK ETNTVKYNPK AKMADKSLRQ
AMGYAIDNDA VGQKFYNGLR TGATTLIPPV FKSLHDSEAK GYTLDLDKAK KLLDDAGYKD
VDGDGIREDK EGKPLEIKFA SMSGGETAQP LADYYVQQWK EIGLNVTYTT GRLIDFQAFY
DKLKNDDPEV DIYQGAWGTG SDPSPTGLYG PNSAFNYTRF ESEENTKLLD AIDSKASFDE
EKRKKAFYDW QEYAIDEAFV IPTLYRNEVL PVNDRVVDFT WAVDTKDNPW ATVGVTADSR
K

EF046-1 (SEQ ID NO:169)
TAGGAGGATA TAATGAAAAA AAAACTTATT GTACTATTGT TAGCCTTATT TTTAACGGCA
TGTAGTAATA ATACTGGGGG AAAAAATAGC GACGCTTCAT CTACTGAAGT ATCAACTAAG
CAGCAAACTA CCCAGTCTTC TAAAAAAGAT AGTAGTAATC CGGACACAAC ACCAACTTCT
ACATCATCTA TAACAATTGA AACAACCGAG AATTTAAAGA ATAGAGAATT GAATCCAACA
GATGATGTTT CAAAAACTAG ACGACAATTG TATGAACAAG GAATTAACAG TTCAACAATT
ACGGATAAAG AACTAAAGGA ATATATATCA GAGGCTAAAG AACAAAAGAA AGATGTCATT
AATTATATTA AGCAAAAA
```

TABLE 1-continued

Nucleotide and Amino Acid Seqeuences of E. faecalis Genes.

EF046-2 (SEQ ID NO:170)
MKKKLIV LLLALFLTAC SNNTGGKNSD ASSTEVSTKQ QTTQSSKKDS SNPDTTPTST
SSITIETTEN LKNRELNPTD DVSKTRRQLY EQGINSSTIT DKELKEYISE AKEQKKDVIN
YIKQK

EF046-3 (SEQ ID NO:171)
A
TGTAGTAATA ATACTGGGGG AAAAAATAGC GACGCTTCAT CTACTGAAGT ATCAACTAAG
CAGCAAACTA CCCAGTCTTC TAAAAAAGAT AGTAGTAATC CGGACACAAC ACCAACTTCT
ACATCATCTA TAACAATTGA AACAACCGAG AATTTAAAGA ATAGAGAATT GAATCCAACA
GATGATGTTT CAAAAACTAG ACGACAATTG TATGAACAAG GAATTAACAG TTCAACAATT
ACGGATAAAG AACTAAAGGA ATATATATCA GAGGCTAAAG AACAAAAGAA AGATGTCATT
AATTATATTA AGCAAAAA

EF046-4 (SEQ ID NO:172)
C SNNTGGKNSD ASSTEVSTKQ QTTQSSKKDS SNPDTTPTST
SSITIETTEN LKNRELNPTD DVSKTRRQLY EQGINSSTIT DKELKEYISE AKEQKKDVIN
YIKQK

EF047-1 (SEQ ID NO:173)
TAGGGAAAAC AAGGAGGAAT TCTTATGAAA AAGATAGGGC TTATTTCTAG TGCTTTTCTT
TTAACCCTTG CTTTAGCAGC ATGCGGCGGC GGAAAAAGTA CAGAAAATAC GGATAGTCGT
TCCAGTGCTG CGGAAAGTAC CACAGTCGAG AGTACAAAAG CATCTGCTAC AAAAGAATCA
AGTAGCAAAG CAACAACAAA ATCTAGTGAT GCGAAACCGT CAGGAACAAC AACAGCTGAT
TCGAAAGCAA CAGCTTCTTC TACGAAGGAA GCGGCAAATA ATGGCTCAGC AGAGAAGCAA
TCACCAGCGA AAAATGCGAA TCCAGATGAC CAAGCCAACC AAGTGCTTAA CCAGCTAGCA
AACATGTTTC CTGGTCAAGG CTTACCGCAG GCAATTTTAA CGAGTCAAAC GAATAACTTT
TTAACTGCAG CGACAACTTC ACAAGCGGAT CAAAACAATT TCCGTGTTTT ATATTATGCA
GAAAAAGAAG CGATTCCAGT GAATGATGCA CGTGTCAATC AGTTAACGCC AATTAGTTCT
TTTGAGAAAA AACATATGG CTCTGATGCC GAAGCAAAAA ATGCAGTGAA CCAAATCATT
GACAATGGCG GTCAACCAGT AGATTTAGGT TACAATATTA CTGGGTATAA ACAAGGGGCG
GCAGGTTCTA GTTACTTATC TTGGCAAGAA GGCAATTGGA GTTAGTCGT ACGGGCCTCA
AATATCAATG GTGAATCGCC TGATGATTTA GCGAAAAATG TTGTCAACAT TTTGGAACAA
GAAACATTAC CAGCACCGAA TACCGTTGGT CAAATCACAC TGAACGTGGC AGGAACCACT
GACTATAATC GAAACTCAGT AGTTTGGCAA GCCGGTACAG TCGTTTACTC TGTCCATCAT
TTTGACCCAA TTCAAGCAGT GAAGATGGCA ACATCAATGT AA

EF047-2 (SEQ ID NO:174)
MKK IGLISSAFLL TLALAACGGG KSTENTDSRS SAAESTTVES TKASATKESS
SKATTKSSDA KPSGTTTADS KATASSTKEA ANNGSAEKQS PAKNANPDDQ ANQVLNQLAN
MFPGQGLPQA ILTSQTNNFL TAATTSQADQ NNFRVLYYAE KEAIPVNDAR VNQLTPISSF
EKKTYGSDAE AKNAVNQIID NGGQPVDLGY NITGYKQGAA GSSYLSWQEG NWSLVVRASN
INGESPDDLA KNVVNILEQE TLPAPNTVGQ ITLNVAGTTD YNRNSVVWQA GTVVYSVHHF
DPIQAVKMAT SM

EF047-3 (SEQ ID NO:175)
ATGCGGCGGC GGAAAAAGTA CAGAAAATAC GGATAGTCGT
TCCAGTGCTG CGGAAAGTAC CACAGTCGAG AGTACAAAAG CATCTGCTAC AAAAGAATCA
AGTAGCAAAG CAACAACAAA ATCTAGTGAT GCGAAACCGT CAGGAACAAC AACAGCTGAT
TCGAAAGCAA CAGCTTCTTC TACGAAGGAA GCGGCAAATA ATGGCTCAGC AGAGAAGCAA
TCACCAGCGA AAAATGCGAA TCCAGATGAC CAAGCCAACC AAGTGCTTAA CCAGCTAGCA
AACATGTTTC CTGGTCAAGG CTTACCGCAG GCAATTTTAA CGAGTCAAAC GAATAACTTT
TTAACTGCAG CGACAACTTC ACAAGCGGAT CAAAACAATT TCCGTGTTTT ATATTATGCA
GAAAAAGAAG CGATTCCAGT GAATGATGCA CGTGTCAATC AGTTAACGCC AATTAGTTCT
TTTGAGAAAA AACATATGG CTCTGATGCC GAAGCAAAAA ATGCAGTGAA CCAAATCATT
GACAATGGCG GTCAACCAGT AGATTTAGGT TACAATATTA CTGGGTATAA ACAAGGGGCG
GCAGGTTCTA GTTACTTATC TTGGCAAGAA GGCAATTGGA GTTAGTCGT ACGGGCCTCA
AATATCAATG GTGAATCGCC TGATGATTTA GCGAAAAATG TTGTCAACAT TTTGGAACAA
GAAACATTAC CAGCACCGAA TACCGTTGGT CAAATCACAC TGAACGTGGC AGGAACCACT
GACTATAATC GAAACTCAGT AGTTTGGCAA GCCGGTACAG TCGTTTACTC TGTCCATCAT
TTTGACCCAA TTCAAGCAGT GAAGATGGCA ACATCAATGT AA

EF047-4 (SEQ ID NO:176)
CGGG KSTENTDSRS SAAESTTVES TKASATKESS
SKATTKSSDA KPSGTTTADS KATASSTKEA ANNGSAEKQS PAKNANPDDQ ANQVLNQLAN
MFPGQGLPQA ILTSQTNNFL TAATTSQADQ NNFRVLYYAE KEAIPVNDAR VNQLTPISSF
EKKTYGSDAE AKNAVNQIID NGGQPVDLGY NITGYKQGAA GSSYLSWQEG NWSLVVRASN
INGESPDDLA KNVVNILEQE TLPAPNTVGQ ITLNVAGTTD YNFNSVVWQA GTVVYSVHHF
DPIQAVKMAT SM

EF048-1 (SEQ ID NO:177)
TAAGGAGAAA AGTTCATGAA AAAAAGAAAG GTTTTATTTA CAGCAGTTAT GGTATTGGCA
GGATTACAGT TGCTAAGTGG TTGCGGCAAA ACAGAAGCTT CGGCAAATGA TACGGTAGTC
TTGCGCTATG CGTATGCTAG TAATAGCCAA CCAGTTATCG ATTCTATGAA GAAATTCGGT
GAATTAGTAG AGGAAAAAAC AGATGGTAAA GTTCAAATTG AATATTTTCC AGATGGTCAA
TTAGGAGGAG AAACAGAACT AATTGAATTA ACACAAACAG GTGCAATTGA TTTTGCAAAG

TABLE 1-continued

Nucleotide and Amino Acid Seqeuences of E. faecalis Genes.

```
GTCAGTGGAT CAGCATTAGA AAGTTTTTCT AAAGATTATT CTGTATTTGC CATTCCGTAT
ATTTTTGATA ATGAAAAACA TTTTTTTAAA GTAATGGATA TCAAGCGCT AATGCAACCA
GTGTATGATT CTACAAAAAA ATTAGGATTT GTTGGTTTAA CTTATTATGA CTCTGGTCAA
CGAAGTTTTT ATATGAGCAA AGGGCCTGTT ACATCTCCAG ATGATTTGAA AGGTAAAAAA
ATTCGGGTCA TGCAAAGTGA AACCGCCATC AAAATGGTAG AACTTTTAGG GGGTTCGCCA
GTACCTATGG GTAGTTCGGA AGTATATACT TCTCTACAAT CTAATCTAAT CAACGGTGCA
GAGAATAATG AGTTCGTTTT ATATACAGCT GGTCATGGTG GTGTGGCTAA GTATTATTCT
TATGATGAGC ATACTCGAGT GCCAGATATT GTGATTATGA ACGAGGGAAC AAAAGAACGT
TTGACAGCGA ACAAGAACA AGCGATTGAA GAAGCAGCAA AAGAATCGAC CGCTTTTGAA
AAAACGGTCT TTAAAGAAGC GGTTGAAGAA GAAAAGAAAA AAGCACAAGC AGAATATGGC
GTTGTGTTCA ATCAAGTAGA CAGTGAACCA TTCCAAAAAC TTGTTCAACC GTTGCATGAA
TCATTCAAAA ATAGCTCAGA ACATGGCGAA CTGTATCAGG CTATTCGCCA GTTGGCGGAC
TAA
```

EF048-2 (SEQ ID NO:178)
MKKRKV LFTAVNVLAG LQLLSGCGKT EASANDTVVL RYAYASNSQP VIDSMKKFGE
LVEEKTDGKV QIEYFPDGQL GGETELIELT QTGAIDFAKV SGSALESFSK DYSVFAIPYI
FDNEKHFFKV MDNQALMQPV YDSTKKLGFV GLTYYDSGQR SFYMSKGPVT SPDDLKGKKI
RVMQSETAIK MVELLGGSPV PMGSSEVYTS LQSNLINGAE NNEFVLYTAG HGGVAKYYSY
DEHTRVPDIV INNEGTKERL TAKQEQAIEE AAKESTAFEK TVFKEAVEEE KKKAQAEYGV
VFNQVDSEPF QKLVQPLHES FKNSSEHGEL YQAIRQLAD

EF048-3 (SEQ ID NO:179)
```
TTGCGGCAAA ACAGAAGCTT CGGCAAATGA TACGGTAGTC
TTGCGCTATG CGTATGCTAG TAATAGCCAA CCAGTTATCG ATTCTATGAA GAAATTCGGT
GAATTAGTAG AGGAAAAAC AGATGGTAAA GTTCAAATTG AATATTTTCC AGATGGTCAA
TTAGGAGGAG AAACAGAACT AATTGAATTA ACACAAACAG GTGCAATTGA TTTTGCAAAG
GTCAGTGGAT CAGCATTAGA AAGTTTTTCT AAAGATTATT CTGTATTTGC CATTCCGTAT
ATTTTTGATA ATGAAAAACA TTTTTTTAAA GTAATGGATA TCAAGCGCT AATGCAACCA
GTGTATGATT CTACAAAAAA ATTAGGATTT GTTGGTTTAA CTTATTATGA CTCTGGTCAA
CGAAGTTTTT ATATGAGCAA AGGGCCTGTT ACATCTCCAG ATGATTTGAA AGGTAAAAAA
ATTCGGGTCA TGCAAAGTGA AACCGCCATC AAAATGGTAG AACTTTTAGG GGGTTCGCCA
GTACCTATGG GTAGTTCGGA AGTATATACT TCTCTACAAT CTAATCTAAT CAACGGTGCA
GAGAATAATG AGTTCGTTTT ATATACAGCT GGTCATGGTG GTGTGGCTAA GTATTATTCT
TATGATGAGC ATACTCGAGT GCCAGATATT GTGATTATGA ACGAGGGAAC AAAAGAACGT
TTGACAGCGA ACAAGAACA AGCGATTGAA GAAGCAGCAA AAGAATCGAC CGCTTTTGAA
AAAACGCTCT TTAAAGAAGC GGTTGAAGAA GAAAAGAAAA AAGCACAAGC AGAATATGGC
GTTGTGTTCA ATCAAGTAGA CAGTGAACCA TTCCAAAAAC TTGTTCAACC GTTGCATGAA
TCATTCAAAA ATAGCTCAGA ACATGGCGAA CTGTATCAGG CTATTCGCCA GTTGGCGGAC
TAA
```

EF048-4 (SEQ ID NO:180)
CGKT EASANDTVVL RYAYASNSQP VIDSMKKFGE
LVEEKTDGKV QIEYFPDGQL GGETELIELT QTGAIDFAKV SGSALESFSK DYSVFAIPYI
FDNEKHFFKV MDNQALMQPV YDSTKKLGFV GLTYYDSGQR SFYMSKGPVT SPDDLKGKKI
RVMQSETAIK MVELLGGSPV PMGSSEVYTS LQSNLINGAE NNEFVLYTAG HGGVAKYYSY
DEHTRVPDIV IMNEGTKERL TAKQEQAIEE AAKESTAFEK TVFKEAVEEE KKKAQAEYGV
VFNQVDSEPF QKLVQPLHES FKNSSEHGEL YQAIRQLAD

EF049-1 (SEQ ID NO:181)
```
TGAGACTCTT TCTTTTTCAA AATGAGGTAT GGTATAGTTA TAACAGANAT AAAACTANAA
AAAACAGGAG TGCATAAGAG AATGAAGAAA AAACTAATCT TAGCTGCAGC GGGCGCAATG
GCCGTTTTTA GTTAGCAGC GTGTTCAAGC GGTTCAAAAG ATATCGCAAC AATGAAAGGT
TCAACAATTA CTGTTGATGA TTTTTATAAC CAAATTAAAG AACAAAGCAC TAGCCAACAA
GCGTTTAGCC AAATGGTTAT TTATAAAGTC TTTGAAGAAA AATATGGCGA CAAAGTAACT
GACAAAGANA TTCAAAAAAA CTTTGACGAA GCCAAAGAAC AAGTAGAAGC ACAAGCCGGA
AAGTTCTCTG ATGCATTAAA ACAAGCTGGT TTAACTGAAA AACATTCAA GAAACAGTTA
AAACAAAGAG CAGCCTATGA TGCAGGTCTA AAAGCCCACT TAAAAATTAC AGATGAAGAC
TTAAAAACAG CTTGGGCAAG TTTCCATCCA GAAGTAGAAG CACAAATTAT CCAAGTTGCT
TCAGAAGATG ATGCCAAAGC TGTCAAGAAA GAAATCACTG ACGGCGGCGA TTTCACAAAA
ATTGCTAAAG AAAAATCAAC AGATACTGCT ACGAAAAAAG ATGGCGGTAA AATTAAATTT
GATTCACAAG CAACAACTGT TCCTGCCGAA GTTAAAGAAG CTGCCTTCAA ATTAAAAGAT
GGCGAAGTGT CAGAACCAAT TGCTGCAACA AATATGCAAA CCTACCAAAC AACCTACTAT
GTAGTGAAAA TGACGAAAAA CAAAGCAAAA GGCAATGACA TGAAACCTTA TGAAAAAGAG
ATCAAGAAAA TTGCTGAAGA AACAAAATTA GCCGATCAAA CATTTGTTTC GAAAGTCATT
AGTGACGAAT TAAAAGCGGC CAATGTGAAA ATTAAAGATG ATGCCTTCAA GAACGCTTTA
GCAGGCTACA TGCAAACTGA ATCTTCAAGC GCTTCTTCAG AGAAAAAGA ATCAAAATCA
AGTGATTCTA AAACAAGCGA TACCAAAACA AGCGACTCTG AAAAAGCAAC AGATTCTTCA
AGCAAAACAA CAGAATCTTC TTCTAAATAA
```

EF049-2 (SEQ ID NO:182)
MKKK LILAAAGAMA VFSLAACSSG SKDIATMKGS
TITVDDFYNQ IKEQSTSQQA FSQMVIYKVF EEKYGDKVTD KXIQKNFDEA KEQVEAQGGK
FSDALKQAGL TEKTFKKQLK QRAAYDAGLK AHLKITDEDL KTAWASFHPE VEAQIIQVAS
EDDAKAVKKE ITDGGDFTKI AKEKSTDTAT KKDCGKIKFD SQATTVPAEV KEAAFKLKDG
EVSEPIAATN MQTYQTTYYV VKMTKNKAKG NDMKPYEKEI KKIAEETKLA DQTFVSKVIS
DELKAAMVKI KDDAFKNALA GYMQTESSSA SSEKKESKSS DSKTSDTKTS DSEKATDSSS

TABLE 1-continued

Nucleotide and Amino Acid Seqeuences of E. faecalis Genes.

KTTESSSK

EF049-3 (SEQ ID NO:183)
```
GTGTTCAAGC GGTTCAAAAG ATATCGCAAC AATGAAAGGT
TCAACAATTA CTGTTGATGA TTTTTATAAC CAAATTACAA AACAAAGCAC TAGCCAACAA
GCGTTTAGCC AAATGGTTAT TTATAAAGTC TTTGAAGAAA AATATGGCGA CAAAGTAACT
GACAAAGANA TTCAAAAAAA CTTTGACGAA GCCAAAGAAC AAGTAGAAGC ACAAGGCGGA
AAGTTCTCTG ATGCATTAAA ACAAGCTGGT TTAACTGAAA AAACATTCAA GAAACAGTTA
AAACAAAGAG CAGCCTATGA TGCAGGTCTA AAGCCCCACT TAAAAATTAC AGATGAAGAC
TTAAAAACAG CTTGGGCAAG TTTCCATCCA GAAGTAGAAG CACAAATTAT CCAAGTTGCT
TCAGAAGATG ATGCCAAAGC TGTCAAGAAA GAAATCACTG ACGGCGGCGA TTTCACAAAA
ATTGCTAAAG AAAAATCAAC AGATACTGCT ACGAAAAAAG ATGGCGGTAA AATTAAATTT
GATTCACAAG CAACAACTGT TCCTGCCGAA GTTAAAGAAG CTGCCTTCAA ATTAAAAGAT
GGCGAAGTGT CAGAACCAAT TGCTGCAACA AATATGCAAA CCTACCAAAC AACCTACTAT
GTAGTGAAAA TGACGAAAAA CAAAGCAAAA GGCAATGACA TGAAACCTTA TGAAAAAGAG
ATCAAGAAAA TTGCTGAAGA AACAAAATTA GCCGATCAAA CATTTGTTTC GAAAGTCATT
AGTGACGAAT TAAAAGCGGC CAATGTGAAA ATTAAAGATG ATGCCTTCAA GAACGCTTTA
GCAGGCTACA TGCAAACTGA ATCTTCAAGC GCTTCTTCAG AGAAAAAAGA ATCAAAATCA
AGTGATTCTA AAACAAGCGA TACCAAAACA AGCGACTCTG AAAAAGCAAC AGATTCTTCA
AGCAAAACAA CAGAATCTTC TTCTAAATAA
```

EF049-4 (SEQ ID NO:184)
```
CSSG SKDIATMKGS
TITVDDFYNQ IKEQSTSQQA FSQMVIYKVF EEKYGDKVTD KXIQKNFDEA KEQVEAQGGK
FSDALKQAGL TEKTFKKQLK QRAAYDAGLK AHLKITDEDL KTAWASFHPE VEAQIIQVAS
EDDAKAVKKE ITDGGDFTKI AKEKSTDTAT KKDGGKIKFD SQATTVPAEV KEAAFKLKDG
EVSEPIAATN MQTYQTTYYV VKMTKNKAKG NDMKPYEKEI KKIAEETKLA DQTFVSKVIS
DELKAAAVKI KDDAFKNALA GYMQTESSSA SSEKKESKSS DSKTSDTKTS DSEKATDSSS
KTTESSSK
```

EF050-1 (SEQ ID NO:185)
```
TAGGGTCTGG AAAAGCAGTC AACTGACTTC TTTTCCAAGC CCTTTTTTAG TTCATCGCAG
AAAGGATGNA AAAAAATGAA CATGCCCAAA AATATCNGTT ATTTTTCTTT GCTAATGGGT
CTTGTTCTAT TATTAAGTGC TTGCCAAATT GGGGCAACTA CGAAGGATGA CAACCAAGCC
GCCACAAAAG AAGCAACTGT TGAGTTAAAC CGCACAACAA CACCAACGCT TTTTTTTCAT
GGTTACGCAG GAACTAAAAA TTCGTTTGGC TCGTTACTGC ATCGCTTGGA GAAACAAGGT
GCCACAACTC AAGAATTAGT GCTACTCGTT AAACCTGATG GGACCGTGGT TAAAGAGCGA
GGAGCTTTAA GTGGCAAAGC GACGAATCCC AGTGTTCAAG TTCTATTTGA AGATAATAAA
AACAATGAAT GGAATCAAAC AGAATGGATA AAAAACACAT TACTCTATTT ACAAAAAAAT
TATCAAGTGA ACAAAGCCAA TATTGTCGGG CACTCTATGG GTGGTGTTAG TGGTTTACGT
TATTTAGGAA CCTATGGGCA AGATACATCG TTACCTAAAA TTGAAAAATT CGTCAGCATT
GGAGCACCTT TCAATGATTT TATTGATACG AGTCAACAGC AAACCATCGA AACGGAACTA
GAAAACGGCC CCACAGAAAA AAGTAGCCGC TATTTGGATT ATCAAGAGAT GATTAATGTT
GTTCCAGAAA AACTGCCCAT TTTATTAATT GGTGGTCAAT TAAGTCCAAC AGATTTAAGT
GATGGAACGG TGCCGTTATC TAGTGCCTTA GCAGTCAACG CCTTGCTAAG ACAGCGAGGA
ACTCAAGTCA CTAGCCAGAT TATTAAAGGA GAAAATGCAC AACATAGTCA ATTACATGAA
AATCCTGAAG TAGATCAATT GCTAATCGAA TTTCTATGGC CGAGTAAAAA ATAG
```

EF050-2 (SEQ ID NO:186)
```
MNMPKN IXYFSLLMGL VLLLSACQIG ATTKDDNQAA
TKEATVELNR TTTPTLFFHG YAGTKNSFGS LLHRLEKQGA TTQELVLLVK PDGTVVKERG
ALSGKATNPS VQVLFEDNKN NEWNQTEWIK NTLLYLQKNY QVNKANIVGH SMGGVSGLRY
LGTYGQDTSL PKIEKFVSIG APFNDFIDTS QQQTIETELE NGPTEKSSRY LDYQEMINVV
PEKLPILLIG GQLSPTDLSD GTVPLSSALA VNALLRQRGT QVTSQIIKGE NAQHSQLMEN
PEVDQLLIEF LWPSKK
```

EF050-3 (SEQ ID NO:187)
```
TTGCCAAATT GGGGCAACTA CGAAGGATGA CAACCAAGCC
GCCACAAAAG AAGCAACTGT TGAGTTAAAC CGCACAACAA CACCAACGCT TTTTTTTCAT
GGTTACGCAG GAACTAAAAA TTCGTTTGGC TCGTTACTGC ATCGCTTGGA GAAACAAGGT
GCCACAACTC AAGAATTAGT GCTACTCGTT AAACCTGATG GGACCGTGGT TAAAGAGCGA
GGAGCTTTAA GTGGCAAAGC GACGAATCCC AGTGTTCAAG TTCTATTTGA AGATAATAAA
AACAATGAAT GGAATCAAAC AGAATGGATA AAAAACACAT TACTCTATTT ACAAAAAAAT
TATCAAGTGA ACAAAGCCAA TATTGTCGGG CACTCTATGG GTGGTGTTAG TGGTTTACGT
TATTTAGGAA CCTATGGGCA AGATACATCG TTACCTAAAA TTGAAAAATT CGTCAGCATT
GGAGCACCTT TCAATGATTT TATTGATACG AGTCAACAGC AAACCATCGA AACGGAACTA
GAAAACGGCC CCACAGAAAA AAGTAGCCGC TATTTGGATT ATCAAGAGAT GATTAATGTT
GTTCCAGAAA AACTGCCCAT TTTATTAATT GGTGGTCAAT TAAGTCCAAC AGATTTAAGT
GATGGAACGG TGCCGTTATC TAGTGCCTTA GCAGTCAACG CCTTGCTAAG ACAGCGAGGA
ACTCAAGTCA CTAGCCAGAT TATTAAAGGA GAAAATGCAC AACATAGTCA ATTACATGAA
AATCCTGAAG TAGATCAATT GCTAATCGAA TTTCTATGGC CGAGTAAAAA ATAG
```

EF050-4 (SEQ ID NO:188)
```
CQIG ATTKDDNQAA
TKEATVELNR TTTPTLFFHG YAGTKNSFGS LLHRLEKQGA TTQELVLLVK PDGTWKERG
ALSGKATNPS VQVLFEDNKN NEWNQTEWIK NTLLYLQKNY QVNKANIVGH SMGGVSGLRY
LGTYGQDTSL PKIEKFVSIG APFNDFIDTS QQQTIETELE NGPTEKSSRY LDYQEMINVV
```

TABLE 1-continued

Nucleotide and Amino Acid Seqeuences of E. faecalis Genes.

PEKLPILLIG GQLSPTDLSD GTVPLSSALA VNALLRQRGT QVTSQIIKGE NAQHSQLHEN
PFVDQLLIEF LWPSKK

EF051-1 (SEQ ID NO:189)
TAAAAGAAAA GAGGCGTTCA AATGTCTAAA CAAAAAAAGG CTGTGTTCCT GCTTAGTTTA
TTCAGTTTAG TTGCCCTAAT TGCTGCATGT ACAAATCAGC CGCAAAAAGA AACAGTTTCA
ACAAAAAAAG AAGAAATAAC CCTTGCGGCA GCAGCTAGCT TAGAATCAGT CATGGAGAAG
AAAATTATTC CAGCCTTTGA AAAAGAGCAT CCAGATATTC AGGTAACTGG AACCTATGAT
AGTTCTGGAA AATTACAGAT GCAAATTGAA AAAGGCCTAA AAGCCGATGT ATTTTTCTCA
GCTTCGACAA AACAAATGAA TGCATTGGTT GCAGAAAAAC TAATTAATAA AAAAAGTGTC
GTTCCTTTAT TGGAAAACCA GCTCGTTCTT ATTGTGCCTA ACCAAGATCA AGCAAAGTGG
CATGATTTTT CTGATTTAAA AAAAGCCCAA ATGATAGCAA TTGGTGATCC TGCAAGTGTT
CCAGCTGGTC AATATGCCGA AGAAGGCTTA AAAGCTTTAG GCGCTTGGTC TTATGTAGAA
AAACACGCAA GCTTTGGCAC GAATGTAACA GAAGTCCTTG AATGGGTAGC TAATGCAAGT
GCAGAAGCTG GCTTAGTTTA TGCGACAGAT GCAGCAACCA ATTCAAAAGT AGCGATTGTT
GCGGCCATGC CTGAAGCTGT TTTGAAAAAG CCAATTATCT ATCCAGTTGG TAAAGTTGCC
GCCTCTAAGA AACAAAAATC AGCAGATGCT TTTTTAAATT TTTTACAGAG TCAACAATGC
AGAAAATATT TTGANAATAT TGGCTTTAAG TTAACAAAGT AG

EF051-2 (SEQ ID NO:190)
MSKQ KKAVFLLSLF SLVALIAACT NQPQKETVST KKEEITLAAA ASLESVMEKK
IIPAFEKEHP DIQVTGTYDS SGKLQMQIEK GLKADVFFSA STKQMNALVA EKLINKKSVV
PLLENQLVLI VPNQDQAKWH DFSDLKKAQM IAIGDPASVP AGQYAEEGLK ALGAWSYVEK
HASFGTNVTE VLEWVANASA EAGLVYATDA ATNSKVAIVA AMPEAVLKKP IIYPVGKVAA
SKKQKSADAF LNFLQSQQCR KYFXNIGFKL TK

EF051-3 (SEQ ID NO:191)
ATGT ACAAATCAGC CGCAAAAAGA AACAGTTTCA
ACAAAAG AAGAAATAAC CCTTGCGGCA GCAGCTAGCT TAGAATCAGT CATGGAGAAG
AAAATTATTC CAGCCTTTGA AAAAGAGCAT CCAGATATTC AGGTAACTGG AACCTATGAT
AGTTCTGGAA AATTACAGAT GCAAATTGAA AAAGGCCTAA AAGCCGATGT ATTTTTCTCA
GCTTCGACAA AACAAATGAA TGCATTGGTT GCAGAAAAAC TAATTAATAA AAAAAGTGTC
GTTCCTTTAT TGGAAAACCA GCTCGTTCTT ATTGTGCCTA ACCAAGATCA AGCAAAGTGG
CATGATTTTT CTGATTTAAA AAAAGCCCAA ATGATAGCAA TTGGTGATCC TGCAAGTGTT
CCAGCTGGTC AATATGCCGA AGAAGGCTTA AAAGCTTTAG GCGCTTGGTC TTATGTAGAA
AAACACGCAA GCTTTGGCAC GAATGTAACA GAAGTCCTTG AATGGGTAGC TAATGCAAGT
GCAGAAGCTG GCTTAGTTTA TGCGACAGAT GCAGCAACCA ATTCAAAAGT AGCGATTGTT
GCGGCCATGC CTGAAGCTGT TTTGAAAAAG CCAATTATCT ATCCAGTTGG TAAAGTTGCC
GCCTCTAAGA AACAAAAATC AGCAGATGCT TTTTTAAATT TTTTACAGAG TCAACAATGC
AGAAAATATT TTGANAATAT TGGCTTTAAG TTAACAAAGT AG

EF051-4 (SEQ ID NO:192)
CT NQPQKETVST KKEEITLAAA ASLESVMEKK
IIPAFEKEHP DIQVTGTYDS SGKLQMQIEK GLKADVFFSA STKQMNALVA EKLINKKSVV
PLLENQLVLI VPNQDQAKWH DFSDLKKAQM IAIGDPASVP AGQYAEEGLK ALGAWSYVEK
HASFGTNVTE VLEWVANASA EAGLVYATDA ATNSKVAIVA AMPEAVLKKP IIYPVGKVAA
SKKQKSADAF LNFLQSQQCR KYFXNIGFKL TK

EF052-1 (SEQ ID NO:193)
TAAAGTAGGA GAAGCGCAAG CGAAAAAAGT GAATCAATCG GCAGCGTATC AAGTAGTGAT
CCCACAATGG GTACCATGGG TAGCATTATC TTTGACAGTA GCACTTGCTG GATTGATTGC
TTACTTAGTT CGTCGTGGAG AGAAGTGGAA AAACGAAGGG GAAGTGACAT AATGAGANGA
NGAAATCTTC NGTTTTTATT ATTGTTGGTT CTATTAATTT ATATTCCTCA AACAACTTAT
GCAGAAAATA GGGAGACCAC AGAAGTCGGA ATCGGGTTTA CAAAAACTTC AGACATACCA
TCAAAAAAAA ATCCAGTTGT GAATGTATTG CCGCAAACAA CCATTCAATC GCTATCAATC
GTTCGTAGCA GAACGCAAAT AAAAAGATTA CCTAAAACTG GTGACAATCG AATAACTTGG
CTAAGCTGGT TTGGCATATT GTTTTTAATA AGTAGTTTTT GGCTGTTTCT ATTTAGACAA
TTATGTAGAA AAGGAGAATA A

EF052-2 (SEQ ID NO:194)
MRXX
NLXFLLLLVL LIYIPQTTYA ENRETTEVGI GFTKTSDIPS KKNPVNNVLP QTTIQSLSIV
RSRTQIKRLP KTGDNRITWL SWFGILFLIS SFWLFLFRQL CRKGE

EF052-3 (SEQ ID NO:195)
AGAAAATA GGGAGACCAC AGAAGTCGGA ATCGGGTTTA CAAAAACTTC AGACATACCA
TCAAAAAAAA ATCCAGTTGT GAATGTATTG CCGCAAACAA CCATTCAATC GCTATCAATC
GTTCGTAGCA GAACGCAAAT AAAAAGAT

EF052-4 (SEQ ID NO:196)
ENRETTEVGI GFTKTSDIPS KKNPVNNVLP QTTIQSLSIV
RSRTQIKR

EF053-1 (SEQ ID NO:197)
TAGTCATGGC ACCATAACAA GGAGGAGAGA AGTGAGATGA AAAAATACCT TTTGCTTAGT
TGTTTTTTAG GTCTTTTCAG CTTCTGTCAT TCAGACACTG CGTTTGGAGA AGCAGCTTAT
GAAATAGTG GTGTTGTCTC CTTTTATGGA ACGTATGAAT ATCCCACAGA AGAGTCGACA

TABLE 1-continued

Nucleotide and Amino Acid Seqeuences of *E. faecalis* Genes.

ACAGCGACTA GTAATTCTTC CACAACGACC GAACCCACCA AGCCAGCTGA CGGAGGCGCT
TCATCCGTCC TTTCTTCTGG CGTATATGGA TCGCGACAAG GAAGATTACC AGCGACAGGT
ACCACCAATC AAGCACCATT TATTTATTTG GGAATCAGCC TTATCACTAT AGGCATATTA
TTTATTAAAA GGAGAAGAGA AGATGAAAAA AACAGTATTA GCAGTAGTAG GGATTGTAGG
ATTTAG

EF053-2 (SEQ ID NO:198)
MKKYLLLSC FLGLFSFCHS DTAFGEAAYE NSGWSFYGT YEYPTEESTT
ATSNSSTTTE PTKPADGGAS SVLSSGVYGS RQGRLPATGT TNQAPFIYLG ISLITIGILF
IKRRREDEKN SISSSRDCRI

EF053-3 (SEQ ID NO:199)
TTTGGAGA AGCAGCTTAT
GAAAATAGTG GTGTTGTCTC CTTTTATGGA ACGTATGAAT ATCCCACAGA AGAGTCGACA
ACAGCGACTA GTAATTCTTC CACAACGACC GAACCCACCA AGCCAGCTGA CGGAGGCGCT
TCATCCGTCC TTTCTTCTGG CGTATATGGA TCGCGACAAG GAAGA

EF053-4 (SEQ ID NO:200)
FGEAAYE NSGWSFYGT YEYPTEESTT
ATSNSSTTTE PTKPADGGAS SVLSSGVYGS RQGR

EF054-1 (SEQ ID NO:201)
TAAATAAAAA ATTATTTGGA GGAAATTACA ATGAAAAAAA TTATTTTATC AAGCTTGTTT
AGTGCAGTAC TAGTATTCGG TGGCGGAAGT ATAACAGCAT TCGCTGACGA TTTAGGACCA
ACAGATCCAG CAACTCCACC AATTACCGAA CCAACTGATT CTAGTGAACC TACGAATCCT
ACTGAGCCGG TGGATCCTGC AGAACCGCCA GTAATACCAA CTGATCCAAC AGAACCAAGC
AAGCCAACCG AGCCTACAAC ACCGAGTGAG CCAGAAAAGC CAACAGAACC AACAACGCCA
ATTGATCCTG AACGCCGGT TGAACCGACT GAACCAAGCG AGCCAACAGA ACCTAGTCAA
CCAACCGAGC CTACAACACC AAGCGAACCA GAAAAACCTG TTACTCCAGA CAACCGAAA
GAACCAACTC AACCAGTGAT TCCAGAAAAA CCAGCAGAAC CAGAAACACC AAAAACTCCT
GAACAGCCCA CTAAACCAAT AGACGTAGTC GTTACACCTA GTGGAGAAAT TGATAAAACG
AATCAATCGG CAGGAACACA ACCAAGTATT CCTATTGAAA CAAGCAACTT AGCGGAGGTA
ACACATGTAC AAGTGAAAC TACTCCAATT ACAACAGAAG CTGGGGAAGA AATTGTAGCA
GTAGATAAAG GTGTTCCGTT AACCAAAACA CCAGAAGGAT TAAAACCAAT TAGCAGCTCG
TATAAGGTTT TACCTAGCGG AAACGTTGAG GTAAAAGCAA GTGATGGAAA AATGAAAGTA
TTGCCACATA CAGGAGAGAA ATTCACACTC CTTTTCTCTG TATTGGGAAG CTTCTTTGTA
TTAATTTCAG GATTCTTTTT CTTTAAAAAG AATAAGAAAA AAGCTTAA

EF054-2 (SEQ ID NO:202)
M KKIILSSLFS AVLVFGGGSI TAFADDLGPT DPATPPITEP TDSSEPTNPT
EPVDPAEPPV IPTDPTEPSK PTEPTTPSEP EKPTEPTTPI DPGTPVEPTE PSEPTEPSQP
TEPTTPSEPE KPVTPEQPKE PTQPVIPEKP AEPETPKTPE QPTKPIDVVV TPSGEIDKTN
QSAGTQPSIP IETSNLAEVT HVPSETTPIT TEAGEEIVAV DKGVPLTKTP EGLKPISSSY
KVLPSGNVEV KASDGKMKVL PHTGEKFTLL FSVLGSFFVL ISGFFFFKKN KKKA

EF054-3 (SEQ ID NO:203)
A
ACAGATCCAG CAACTCCACC AATTACCGAA CCAACTGATT CTAGTGAACC TACGAATCCT
ACTGAGCCGG TGGATCCTGC AGAACCGCCA GTAATACCAA CTGATCCAAC AGAACCAAGC
AAGCCAACCG AGCCTACAAC ACCGAGTGAG CCAGAAAAGC CAACAGAACC AACAACGCCA
ATTGATCCTG AACGCCGGT TGAACCGACT GAACCAAGCG AGCCAACAGA ACCTAGTCAA
CCAACCGAGC CTACAACACC AAGCGAACCA GAAAAACCTG TTACTCCAGA CAACCGAAA
GAACCAACTC AACCAGTGAT TCCAGAAAAA CCAGCAGAAC CAGAAACACC AAAAACTCCT
GAACAGCCCA CTAAACCAAT AGACGTAGTC GTTACACCTA GTGGAGAAAT TGATAAAACG
AATCAATCGG CAGGAACACA ACCAAGTATT CCTATTGAAA CAAGCAACTT AGCGGAGGTA
ACACATGTAC AAGTGAAAC TACTCCAATT ACAACAGAAG CTGGGGAAGA AATTGTAGCA
GTAGATAAAG GTGTTCCGTT AACCAAAACA CCAGAAGGAT TAAAACCAAT TAGCAGCTCG
TATAAGGTTT TACCTAGCGG AAACGTTGAG GTAAAAGCAA GTGATGGAAA AATGAAAGTA
T

EF054-4 (SEQ ID NO:204)
DDLGPT DPATPPITEP TDSSEPTNPT
EPVDPAEPPV IPTDPTEPSK PTEPTTPSEP EKPTEPTTPI DPGTPVEPTE PSEPTEPSQP
TEPTTPSEPE KPVTPEQPKE PTQPVIPEKP AEPETPKTPE QPTKPIDVVV TPSGEIDKTN
QSAGTQPSIP IETSNLAEVT HVPSETTPIT TEAGEEIVAV DKGVPLTKTP EGLKPISSSY
KVLPSGNVEV KASDGKMKV

EF055-1 (SEQ ID NO:205)
TAACAAAAGG TTGTTTTGTC TTTCTTGTGT AAAAGGGCAA GAAAGGCTAG CGAGTTAAAA
GGAGGTTTTT CAATGAAAAA AAAGCGTTAT TTAATGATTG TGTGTCTACT ATCTTCTCCT
AGTTTTTTTA TAAATGTTGA AGCGTCTGAT GGTGGTTCTA GTTCGGTGGG GATTGAATTT
TACCAAAATC CGAGAACACC CGCTCCTAAA GATCCCCCAC CGAAAACAGA TGCGCCAGCT
GCTGATCCCA AGGAACCAGC TGGTCCTCCG CAAGGGAGATC AACGAAGTGG TGGTTCGACA
CAGACCACCA CAACTGGCTC AACGCTCCCT CGTACAGGGA GCAAGAGTCA GGCAAATTTG
AGCATTCTCN GNTTCGCCTT AATCGGTTTG GCGGGAATCG TACATAGAAA GAAGGGACGA
CATGAAGCAA ACTAA

TABLE 1-continued

Nucleotide and Amino Acid Seqeuences of *E. faecalis* Genes.

EF0B5-2 (SEQ ID NO:206)
MKKKRYL MIVCLLSSPS FFINVEASDG GSSSVGIEFY
QNPRTPAPKD PPPKTDAPAA DPKEPAGPPQ GDQRSGGSTQ TTTTGSTLPR TGSKSQANLS
ILXFALIGLA GIVHRKKGRH EAN

EF055-3 (SEQ ID NO:207)
AGCGTCTGAT GGTGGTTCTA GTTCGGTGGG GATTGAATTT
TACCAAAATC CGAGAACACC CGCTCCTAAA GATCCCCCAC CGAAAACAGA TGCGCCAGCT
GCTGATCCCA AGGAACCAGC TGGTCCTCCG CAAGGAGATC AACGAAGTGG TGGTTCGACA
CAGACCACCA CAACTGGCTC AACG

EF055-4 (SEQ ID NO:208)
SDG GSSSVGIEFY
QNPRTPAPKD PPPKTDAPAA DPKEPAGPPQ GDQRSGGSTQ TTTTGST

EF056-1 (SEQ ID NO:209)
TAAATGAAAA AAAAGCGTTA TTTAATAATT GCGTGTTTAC TATTTTCCCC TAGTTTTTTT
ATAAATGTTG AAGCATCTGA GGGTGGTTCT AGTTCGGTGG GAATTGAATT TTACCAAAAT
CCGGCAACAC CCGCTCCTAA AGATGCCCCA CCGAAAACAG ATGAGCCAGC TGCGGATCCC
AAGGAACCAG CTGGTCCTCT GCAAGGAGAT CAACGAAGTG GTGGTTCGAC ACAGACCACC
ACAGCTGGCT CGCAGCTCCC TCGTACAGGA AGCAAGAGTC AGGCAAACCT GAGCATTCTT
GGTCTTGTCT TGATTGGTCT TGTCGGAATG GTCCAGAGAA AGAAGGGACG ACATGAAGCA
AACTAA

EF056-2 (SEQ ID NO:210)
MKKKRYLIIA CLLFSPSFFI NVEASEGGSS SVGIEFYQNP ATPAPKDAPP KTDEPAADPK
EPAGPLQGDQ RSGGSTQTTT AGSQLPRTGS KSQANLSILG LVLIGLVGMV QRKKGRHEAN

EF056-3 (SEQ ID NO:211)
ATCTGA GGGTGGTTCT AGTTCGGTGG GAATTGAATT TTACCAAAAT
CCGGCAACAC CCGCTCCTAA AGATGCCCCA CCGAAAACAG ATGAGCCAGC TGCGGATCCC
AAGGAACCAG CTGGTCCTCT GCAAGGAGAT CAACGAAGTG GTGGTTCGAC ACAGACCACC
ACAGCTGGCT CGCAG

EF056-4 (SEQ ID NO:212)
SEGGSS SVGIEFYQNP ATPAPKDAPP KTDEPAADPK
EPAGPLQGDQ RSGGSTQTTT AGSQ

EF057-1 (SEQ ID NO:213)
TAATGTTTAT TGGCTGGGCC AGTCAATGTT GAAAATGGGG AAGGAGGAAT TCAGATGAAA
ATCATAAAAA GGTTTAGTTT GGTATGTTTA GGGCTATTGA TCATTGGGTT GCNAACAAAA
AGCGNTATGG CTGAAGAAAA TAATTATGAA TCAAATGGTC AAGCGAGCTT CTATGGTACC
TACGTTTATG AGAATGAAAA AGAGTCAAAT GACGTAGCGT ATACCCAACA ATCAGAAGAA
CAGGGAAGAA ACAATTTAGC TGCTTCTGGA CAAGCAGTTT TACCTAAAAC AGGCGAGTCT
GAAAATCCGC TGTATTCCTT GATAGGAGTT AGTTTGTTGG GGATAGTCAT TTATTTAATT
AATAAAATGA AACGAGAGAA GGAGTTTATT TAA

EF057-2 (SEQ ID NO:214)
MKI IKRFSLVCLG LLIIGLXTKS XMAEENNYES NGQASFYGTY
VYENEKESND VAYTQQSEEQ GRNNLAASGQ AVLPKTGESE NPLYSLIGVS LLGIVIYLIN
KMKREKEFI

EF057-3 (SEQ ID NQ:215)
AAA TAATTATGAA TCAAATGGTC AAGCGAGCTT CTATGGTACC
TACGTTTATG AGAATGAAAA AGAGTCAAAT GACGTAGCGT ATACCCAACA ATCAGAAGAA
CAGGGAAGAA ACAATTTAGC TGCTTCTGGA CAAGCAGTTT

EF057-4 (SEQ ID NO:216)
EENNYES NGQASFYGTY
VYENEKESND VAYTQQSEEQ GRNNLAASGQ AV

EF058-1 (SEQ ID NO:217)
TGAAGAACGT TCTATTTGGT TGACGATTGC AGGCCTGCTA ATCATTGGGA TGGTAGTCAT
TTGGCTATTT TATCAAAAAC AAAAAAGAGG AGAGAGAAAA TGAAGCAATT AAAAAAAGTT
TGGTACACCG TTAGTACCTT GTTACTAATT TTGCCACTTT TCACAAGTGT ATTAGGGACA
ACAACTGCAT TTGCAGAAGA AAATGGGGAG AGCGCACAGC TCGTGATTCA CAAAAAGAAA
ATGACGGATT TACCAGATCC GCTTATTCAA AATAGCGGGA AAGAAATGAC CGAGTTTGAT
AAATATCAAG GACTGGCAGA TGTGACGTTT AGTATTTATA ACGTGACGAA CGAATTTTAC
GAGCAACGAG CGGCAGGCGC AAGCGTTGAT GCAGCTAAAC AAGCTGTCCA AGTTTAACT
CCTGGGAAAC CTGTTGCTCA AGGAACCACC GATGCAAATG GAATGTCAC TGTTCAGTTA
CCTAAAAAAA CAAATGGTAA AGATGCAGTG TATACCATTA AAGAAGAACC AAAAGAGGGT
GTAGTTGCTG CTACGAATAT GGTGGTGGCG TTCCCAGTTT ACGAAATGAT CAAGCAAACA
GATGGTTCCT ATAAATATGG AACAGAAGAA TTAGCGGTTG TTCATATTTA TCCTAAAAAT
GTGGTAGCCA ATGATGGTAG TTTACATGTG AAAAAAGTAG GAACTGCTGA AAATGAAGGA
TTAAATGGCG CAGAATTTGT TATTTCTAAA GCGAAGGCT CACCAGGCAC AGTAAAATAT
ATCCAAGGAG TCAAAGATGG ATTATATACA TGGACAACGG ATAAAGAACA AGCAAAACGC
TTTATTACTG GGAAAAGTTA TGAAATTGGC GAAAATGATT TCACAGAAGC AGAGAATGGA

TABLE 1-continued

Nucleotide and Amino Acid Seqeuences of E. faecalis Genes.

```
ACGGGAGAAT TAACAGTTAA AAATCTTGAG GTTGGTTCGT ATATTTTAGA AGAAGTAAAA
GCTCCAAATA ATGCAGAATT AATTGAAAAT CAAACAAAAA CACCATTTAC AATTGAAGCA
AACAATCAAA CACCTGTTGA AAAAACAGTC AAAAATGATA CCTCTAAAGT TGATAAAACA
ACACCAAGCT TAGATGGTAA AGATGTGGCA ATTGGCAAAA AAATTAAATA TCAAATTTCT
GTAAATATTC CATTGGGGAT TGCAGACAAA GAAGGCGACG CTAATAAATA CGTCAAATTC
AATTTAGTTG ATAAACATGA TGCAGCCTTA ACTTTTGATA ACGTGACTTC TGGAGAGTAT
GCTTATGCGT TATATGATGG GGATACAGTG ATTGCTCCTG AAAATTATCA AGTGACTGAA
CAAGCAAATG GCTTCACTGT CGCCGTTAAT CCAGCGTATA TTCCTACGCT AACACCAGGC
GGCACACTAA AATTCGTTTA CTTTATGCAT TTAAATGAAA AAGCAGATCC TACGAAAGGC
TTTAAAAATG AGGCGAATGT TGATAACGGT CATACCGACG ACCAAACACC ACCAACTGTT
GAAGTTGTGA CAGGTGGGAA ACGTTTCATT AAAGTCGATG GCGATGTGAC AGCGACACAA
GCCTTGGCGG GAGCTTCCTT TGTCGTCCGT GATCAAAACA GCGACACAGC AAATTATTTG
AAAATCGATG AAACAACGAA AGCAGCAACT TGGGTGAAAA CAAAGCTGA AGCAACTACT
TTTACAACAA CGGCTGATGG ATTAGTTGAT ATCACAGGGC TTAAATACGG TACCTATTAT
TTAGAAGAAA CTGTAGCTCC TGATGATTAT GTCTTGTTAA CAAATCGGAT TGAATTTGTG
GTCAATGAAC AATCATATGG CACAACAGAA AACCTAGTTT CACCAGAAAA AGTACCAAAC
AAACACAAAG GTACCTTACC TTCAACAGGT GGCAAAGGAA TCTACGTTTA CTTAGGAAGT
GGCGCAGTCT TGCTACTTAT TGCAGGAGTC TACTTTGCTA GACGTAGAAA AGAAAATGCT
TAA

EF058-2 (SEQ ID NO:218)
MKQLKKVW YTVSTLLLIL PLFTSVLGTT
TAFAEENGES AQLVIHKKKM TDLPDPLIQN SGKEMSEFDK YQGLADVTFS IYNVTNEFYE
QRAAGASVDA AKQAVQSLTP GKPVAQGTTD ANGNVTVQLP KKQNGKDAVY TIKEEPKEGV
VAATNMVVAF PVYEMIKQTD GSYKYGTEEL AVVHIYPKNV VANDGSLHVK KVGTAENEGL
NGAEFVISKS EGSPGTVKYI QGVKDGLYTW TTDKEQAKRF ITGKSYEIGE NDFTEAENGT
GELTVKNLEV GSYILEEVKA PNNAELIENQ TKTPFTIEAN NQTPVEKTVK NDTSKVDKTT
PSLDGKDVAI GEKIKYQISV NIPLGIADKE GDANKYVKFN LVDKHDAALT FDNVTSGEYA
YALYDGDTVI APENYQVTEQ ANGFTVAVNP AYIPTLTPGG TLKFVYFMHL NEKADPTKGF
KNEAAVDNGH TDDQTPPTVE VVTGGKRFIK VDGDVTATQA LAGASFVVRD QNSDTANYLK
IDETTKAATW VKTKAEATTF TTTADGLVDI TGLKYGTYYL EETVAPDDYV LLTNRIEFW
NEQSYGTTEN LVSPEKVPNK HKGTLPSTGG KGIYVYLGSG AVLLLIAGVY FARRRKENA

EF058-3 (SEQ ID NO:219)
AGAAGA AAATGGGGAG AGCGCACAGC TCGTGATTCA CAAAAGAAA
ATGACGGATT TACCAGATCC GCTTATTCAA AATAGCGGGA AGAAATGAG CGAGTTTGAT
AAATATCAAG GACTGGCAGA TGTGACGTTT AGTATTTATA ACGTGACGAA CGAATTTTAC
GAGCAACGAG CGGCAGGCGC AAGCGTTGAT GCAGCTAAAC AAGCTGTCCA AAGTTTAACT
CCTGGGAAAC CTGTTGCTCA AGGAACCACC GATGCAAATG GAATGTCAC TGTTCAGTTA
CCTAAAAAAC AAAATGGTAA AGATGCAGTG TATACCATTA AAGAAGAACC AAAAGAGGGT
GTAGTTGCTG CTACGAATAT GGTGGTGGCG TTCCCAGTTT ACGAAATGAT CAAGCAAACA
GATGGTTCCT ATAAATATGG AACAGAAGAA TTAGCGGTTG TTCATATTTA TCCTAAAAAT
GTGGTAGCCA ATGATGGTAG TTTACATGTG AAAAAAGTAG GAACTGCTGA AAATGAAGGA
TTAAATGGCG CAGAATTTGT TATTTCTAAA AGCGAAGGCT CACCAGGCAC AGTAAAATAT
ATCCAAGGAG TCAAGATGG ATTATATACA TGGACAACGG ATAAGAACA AGCAAAACGC
TTTATTACTG GGAAAAGTTA TGAAATTGGC GAAAATGATT TCACAGAAGC AGAGAATGGA
ACGGGAGAAT TAACAGTTAA AAATCTTGAG GTTGGTTCGT ATATTTTAGA AGAAGTAAAA
GCTCCAAATA ATGCAGAATT AATTGAAAAT CAAACAAAAA CACCATTTAC AATTGAAGCA
AACAATCAAA CACCTGTTGA AAAAACAGTC AAAAATGATA CCTCTAAAGT TGATAAAACA
ACACCAAGCT TAGATGGTAA AGATGTGGCA ATTGGCAAAA AAATTAAATA TCAAATTTCT
GTAAATATTC CATTGGGGAT TGCAGACAAA GAAGGCGACG CTAATAAATA CGTCAAATTC
AATTTAGTTG ATAAACATGA TGCAGCCTTA ACTTTTGATA ACGTGACTTC TGGAGAGTAT
GCTTATGCGT TATATGATGG GGATACAGTG ATTGCTCCTG AAAATTATCA AGTGACTGAA
CAAGCAAATG GCTTCACTGT CGCCGTTAAT CCAGCGTATA TTCCTACGCT AACACCAGGC
GGCACACTAA AATTCGTTTA CTTTATGCAT TTAAATGAAA AAGCAGATCC TACGAAAGGC
TTTAAAAATG AGGCGAATGT TGATAACGGT CATACCGACG ACCAAACACC ACCAACTGTT
GAAGTTGTGA CAGGTGGGAA ACGTTTCATT AAAGTCGATG GCGATGTGAC AGCGACACAA
GCCTTGGCGG GAGCTTCCTT TGTCGTCCGT GATCAAAACA GCGACACAGC AAATTATTTG
AAAATCGATG AAACAACGAA AGCAGCAACT TGGGTGAAAA CAAAGCTGA AGCAACTACT
TTTACAACAA CGGCTGATGG ATTAGTTGAT ATCACAGGGC TTAAATACGG TACCTATTAT
TTAGAAGAAA CTGTAGCTCC TGATGATTAT GTCTTGTTAA CAAATCGGAT TGAATTTGTG
GTCAATGAAC AATCATATGG CACAACAGAA AACCTAGTTT CACCAGAAAA AGTACCAAAC
AAACACAAAG GTACCTTACC T

EF058-4 (SEQ ID NO:220)
EENGES AQLVIHKKKM TDLPDPLIQN SGKEMSEFDK YQGLADVTFS IYNVTNEFYE
QRAAGASVDA AKQAVQSLTP GKPVAQGTTD ANGNVTVQLP KKQNGKDAVY TIKEEPKEGV
VAATNVVVAF PVYEMIKQTD GSYKYGTEEL AvVHIYPKNV VANDGSLHVK KVGTAENEGL
NGAEFVISKS EGSPGTVKYI QGVKDGLYTW TTDKEQAKRF ITGKSYEIGE NDFTEAENGT
GELTVKNLEV GSYILEEVKA PNNAELIENQ TKTPFTIEAN NQTPVEKTVK NDTSKVDKTT
PSLDGKDVAI GEKIKYQISV NIPLGIADKE GDANKYVKFN LVDKHDAALT FDNVTSGEYA
YALYDGDTVI APENYQVTEQ ANGFTVAVNP AYIPTLTPGG TLKFVYFMHL NEKADPTKGF
KNEANVDNGH TDDQTPPTVE VVTGGKRFIK VDGDVTATQA LAGASFVVRD QNSDTANYLK
IDETTKAATW VKTKAEATTF TTTADGLVDI TGLKYGTYYL EETVAPDDYV LLTNRIEFVV
NEQSYGTTEN LVSPEKVPNK HKGT

EF059-1 (SEQ ID NO:221)
```

TABLE 1-continued

Nucleotide and Amino Acid Seqeuences of *E. faecalis* Genes.

```
TAGATTGGAA GAATGAAAAT GAAAAAAATG ATTATTATTG CCTTATTCAG TACAAGCCTT
TTAGCAGGGG GAAGCAGTGT TTCTGCTTAT GCGCAAGAAT CAGAAGGAAA TCTTGGTGAA
ACAACAGGGA GTGTTTTACC AGATGAACCG AATGTACCAA CTGACCCAAT AACGCCAAGT
GAGCCAGAGC AACCAACAGA GCCAAGTACA CCAGAGCAAC CATCGGAACC GTCAACACCA
ACCGAACCTA GTGAGCCTTC AAAACCGACG GATCCTTCGT TACCAGACGA ACCGAGCGTA
CCAACAGAGC AACAACGCC AAGTAAGCCA GAGCAACCAA CAGAGCCAAC AACGCCAAGT
GTACCAGAGC AACCAACAGA GCCAAGTGTA CCAGAAAAAC CAGTAGAACC AAATAAACCA
ACCGAGCCAG AAAAGCCTGT GCCAGTTGTT CCTGAAAAAC CAGTTGTACC ACAACAACCA
GAGCAACCAA CAGATGTGGT GGTAAAGCCA AATGGAGAAA TTGCAACAGG AGAATCTACA
CAACAGCCAA CTGTTCCAAT TGAAACGAAT AACCTTTCAG AAGTAACACA TGTCCCAACT
GTGACGACAC CGATTGAAAC AGCAAGCGGA GAAGCAATTG TCGCAGTGGA TAAGGGCGTT
CCTTTAACAC AAACGGCTGA TGGATTAAAA CCGATTAAAA GTGAATATAA AGTATTACCA
AGTGGCAATG TACAAGTGAA AAGTGCTGAC GGAAAAATGA AAGTACTTCC TTACACTGGT
GAAAAAATGG GCATAATTGG GTCAATCGCT GGTGTATGTT TGACTGTTTT ATCAGGAATC
TTAATTTATA AAAAACGTAA AGTGTAG

EF059-2 (SEQ ID NO:222)
MKKMI IIALFSTSLL AGGSSVSAYA QESEGNLGET TGSVLPDEPN VPTDPITPSE
PEQPTEPSTP EQPSEPSTPT EPSEPSKPTD PSLPDEPSVP TEPTTPSKPE QPTEPTTPSV
PEQPTEPSVP EKPVEPNKPT EPEKPVPVVP EKPVVPQQPE QPTDVVVKPN GEIATGESTQ
QPTVPIETNN LSEVTHVPTV TTPIETASGE AIVAVDKGVP LTQTADGLKP IKSEYKVLPS
GNVQVKSADG KMKVLPYTGE KMGIIGSIAG VCLTVLSGIL IYKKRKV

EF059-3 (SEQ ID NO:223)
AGAAGGAAA TCTTGGTGAA
ACAACAGGGA GTGTTTTACC AGATGAACCG AATGTACCAA CTGACCCAAT AACGCCAAGT
GAGCCAGAGC AACCAACAGA GCCAAGTACA CCAGAGCAAC CATCGGAACC GTCAACACCA
ACCGAACCTA GTGAGCCTTC AAAACCGACG GATCCTTCGT TACCAGACGA ACCGAGCGTA
CCAACAGAGC AACAACGCC AAGTAAGCCA GAGCAACCAA CAGAGCCAAC AACGCCAAGT
GTACCAGAGC AACCAACAGA GCCAAGTGTA CCAGAAAAAC CAGTAGAACC AAATAAACCA
ACCGAGCCAG AAAAGCCTGT GCCAGTTGTT CCTGAAAAAC CAGTTGTACC ACAACAACCA
GAGCAACCAA CAGATGTGGT GGTAAAGCCA AATGGAGAAA TTGCAACAGG AGAATCTACA
CAACAGCCAA CTGTTCCAAT TGAAACGAAT AACCTTTCAG AAGTAACACA TGTCCCAACT
GTGACGACAC CGATTGAAAC AGCAAGCGGA GAAGCAATTG TCGCAGTGGA TAAGGGCGTT
CCTTTAACAC AAACGGCTGA TGGATTAAAA CCGATTAAAA GTGAATATAA AGTATTACCA
AGTGGCAATG TACAAGTGAA AAGTGCTGAC GGAAAAATGA AAGTAC

EF059-4 (SEQ ID NO:224)
EGNLGET TGSVLPDEPN VPTDPITPSE
PEQPTEPSTP EQPSEPSTPT EPSEPSKPTD PSLPDEPSVP TEPTTPSKPE QPTEPTTPSV
PEQPTEPSVP EKPVEPNKPT EPEKPVPVVP EKPVVPQQPE QPTDVVVKPN GEIATGESTQ
QPTVPIETNN LSEVTHVPTV TTPIETASGE AIVAVDKGVP LTQTADGLKP IKSEYKVLPS
GNVQVKSADG KMKV

EF060-1 (SEQ ID NO:225)
TGAAAAATAG ACAAGGAGCA CGCGATGATG ACAATGAAAA GTAAAGGGTC ACTTCTGGTG
ACGTTGGGAA TACTTTTAAC CGTTGGCATT GCGAGTCTAA TTGTTTCTTC TGAGAGTTTT
GCAGAAGAAG TAGGGCAAAC GAATATCGGT GTAACGTTCT ATGGAGGAAA AGAGCCACTA
AAAACGGAAG GTGTCATTAA GCCAATAGAG CAACCAGTCA CTGATAAAGA TAAAAAAACG
TCACAACAAC AAGACAAAGT GAGCAGAAAA ACCACTGCTA AACGAATCC GACTAATGCA
CAGACGTCAT TACCAAGGAC AGGTGAACGA AATAGCACGT GGCTTTACAG CCTTGGTATT
GCCTGTTTAC TCGTAGTACT AACAAGTTTC TATTATTTGA ATAAAAAAAG GAAAAAGGAA
AAATAA

EF060-2 (SEQ ID NO:226)
MMT MKSKGSLLVT LGILLTVGIA SLIVSSESFAEEVGQTNIGV TFYGGKEPLK
TEGVIKPTEQ PVTDKDKKTS QQQDKVSRKT TAKTNPTNAQ TSLPRTGERN STWLYSLGIA
CLLVVLTSFY YLNKKRKKEK

EF060-3 (SEQ ID NO:227)
AGAAGAAG TAGGGCAAAC GAATATCGGT GTAACGTTCT ATGGAGGAAA AGAGCCACTA
AAAACGGAAG GTGTCATTAA GCCAATAGAG CAACCAGTCA CTGATAAAGA TAAAAAAACG
TCACAACAAC AAGACAAAGT GAGCAGAAAA ACCACTGCTA AACGAATCC GACTAATGCA
CAGACGTCAT

EF060-4 (SEQ ID NO:228)
EEVGQTNIGV TFYGGKEPLK
TEGVIKPIEQ PVTDKDKKTS QQQDKVSRKT TAKTNPTNAQ TS

EF061-1 (SEQ ID NO:229)
TAATGGAACG ACCGACAGAA GAAGATTTTG AACTTACAAA TTAAAATTAA AATGGAGGAA
ATAATGATGA AAAAAATTCT TTTTGCTAGT TTATTTAGTG CCACACTACT ATTTGGGGGA
AGTGAAATTT CTGCTTTTGC ACAAGAAATT ATCCCTGATG ATACTACGAC ACCGCCCATT
GAAGTACCAA CAGAACCAAG TACACCAGAA AAGCCAACAG ATCCAACACC GCCAATTGAG
CCACCTGTAG ACCCTGTAGA GCCACCTATT ACACCAACG AGCCAACAGA ACCGACAGAG
CCGACAACAC CAACAGAACC TACAACTCCT ACAGAGCCAA GTGAACCAGA ACAACCAACG
GAGCCAAGTA AACCAGTAGA ACCTGAAAAA CCAGTTACAC CAAGCAAACC AGCAGAACCC
```

TABLE 1-continued

Nucleotide and Amino Acid Seqeuences of E. faecalis Genes.

```
GAAAAAACTG TGACACCAAC TAAACCAACA GAATCTGAAA AACCAGTACA ACCAGCAGAA
CCAAGCAAGC CAATCGACGT TGTTGTAACG CCAACAGGGG AATTAAATCA CGCTGGAAAT
GGTACACAAC AGCCAACAGT CCCTATTGAA ACAAGTAATT TGGCAGAAAT CACGCACGTG
CCTAGTGTAA CAACACCTAT TACAACTACA GACGGAGAAA ACATTGTAGC TGTAGAAAAA
GGTGTTCCAC TTACACAAAC AGCAGAAGGG TTAAAACCTA TTCAATCNAG TTACAAAGTA
TTGCCTAGCG GAAATGTAGA AGTAAAAGGT AAGGACGGTA AAATGAAGGT TTTACCATAC
ACAGGTGAAG AAATGAATAT CTTTTTATCT GCCGTAGCGG TATCTTGTCT GTAG

EF061-2 (SEQ ID NO:230)
MKKILFASL FSATLLFGGS EISAFAQEII PDDTTTPPIE
VPTEPSTPEK PTDPTPPIEP PVDPVEPPIT PTEPTEPTEP TTPTEPTTPT EPSEPEQPTE
PSKPVEPEKP VTPSKPAEPE KTVTPTKPTE SEKPVQPAEP SKPIDVVVTP TGELNHAGNG
TQQPTVPIET SNLAEITHVP SVTTPITTTD GENIVAVEKG VPLTQTAEGL KPIQSSYKVL
PSGNVEVKGK DGKMKVLPYT GEEMNIFLSA VAVSCL

EF061-3 (SEQ ID NO:231)
GAAATTT CTGCTTTTGC ACAAGAAATT ATCCCTGATG ATACTACGAC ACCGCCCATT
GAAGTACCAA CAGAACCAAG TACACCAGAA AAGCCAACAG ATCCAACACC GCCAATTGAG
CCACCTGTAG ACCCTGTAGA GCCACCTATT ACACCAACGG AGCCAACAGA ACCGACAGAG
CCGACAACAC CAACAGAACC TACAACTCCT ACAGAGCCAA GTGAACCAGA ACAACCAACG
GAGCCAAGTA AACCAGTAGA ACCTGAAAAA CCAGTTACAC CAAGCAAACC AGCAGAACCC
GAAAAAACTG TGACACCAAC TAAACCAACA GAATCTGAAA AACCAGTACA ACCAGCAGAA
CCAAGCAAGC CAATCGACGT TGTTGTAACG CCAACAGGGG AATTAAATCA CGCTGGAAAT
GGTACACAAC AGCCAACAGT CCCTATTGAA ACAAGTAATT TGGCAGAAAT CACGCACGTG
CCTAGTGTAA CAACACCTAT TACAACTACA GACGGAGAAA ACATTGTAGC TGTAGAAAAA
GGTGTTCCAC TTACACAAAC AGCAGAAGGG TTAAAACCTA TTCAATCNAG TTACAAAGTA
TTGCCTAGCG GAAATGTAGA AGTAAAAGGT AAGGACGGTA AAATGAAGGT TT

EF061-4 (SEQ ID NO:232)
QEII PDDTTTPPIE
VPTEPSTPEK PTDPTPPIEP PVDPVEPPIT PTEPTEPTEP TTPTEPTTPT EPSEPEQPTE
PSKPVEPEKP VTPSKPAEPE KTVTPTKPTE SEKPVQPAEP SKPIDVVVTP TGELNHAGNG
TQQPTVPIET SNLAEITHVP SVTTPITTTD GENIVAVEKG VPLTQTAEGL KPIQSSYKVL
PSGNVEVKGK DGKMKV

EF062-1 (SEQ ID NO:233)
TGATTCTTGA AGCAACAAAT GAAAGCAAAA AAACAATATA AGACATATAA AGCTAAGAAT
CACTGGGTAA CTGTCCCTAT TCTTTTTCTA AGTGTGTTGA GAGCCGTAGG ATTAGCTACT
GATAATGTAC AAGCCGCGGA ATTAGATACG CAACCAGAAA CAACGACGGT TCAACCCAAT
AACCCCGACC TGCAGTCAGA AAAGGAAACA CCTAAAACGG CAGTATCTGA AGAAGCAACA
GTACAAAAAG ACACTACTTC TCAACCGACC AAAGTAGAAG AAGTAGCGCC AGAAAATAAA
GGTACTGAAC AAAGTTCAGC TACCCCAAAT GATACCACAA ACGCGCAACA ACCAACAGTA
GGAGCTGAAA AATCAGCACA AGAACAACCA GTAGTAAGCC CTGAAACAAC CAATGAACCT
CTAGGGCAGC AACAGAAGT TGCACCAGCT GAAAATGAAG TGAATAAATC AACGTCCATT
CCTAAAGAAT TTGAAACACC AGACGTTGAT AAAGCAGTTG ATGAAGTAAA AAAGATCCA
AACATTACCG TTGTTGAAAA ACCAGCAGAA GACTTAGGCA ACGTTTCTTC TAAAGATTTA
GCTGCAAAAG AAAAAGAAGT AGACCAACTA CAAAAAGAAC AAGCGAAAAA GATTGCCCAA
CAAGCAGCTG AATTAAAAGC CAAAAATGAA AAAATTGCCA AAGAAAATGC AGAAATTGCG
GCAAAAAACA AAGCNGAAAA AGAGCGNTAN GANAAAGAAG TCGCNGAATA CAACAAGCAT
AAGAACGAAA ACAGCTATGT CAATGAAGCG ATTAGTAAAA ACCTAGTGTT CGATCAATCT
GTCGTGACGA AAGACACTAA AATTTCGTCG ATTAAAGGCG GAAAATTTAT CAAAGCAACT
GATTTTAATA AAGTAAATGC AGGGGATTCA AAAGATATCT TTACAAAATT ACGGAAAGAT
ATGGGNGGGA AAGNTACTGG CAACTTCCAG AATTCCTTTG TAAAAGAGGC AAATCTTGGG
TCTAATGGTG GGTATGCGGT TCTTTTAGAA AAAAATAAAC CAGTGACAGT GACCTATACA
GGACTAAACG CTAGTTATTT AGGACGTAAA ATTACAAAAG CAGAATTTGT TTATGAACTA
CAATCCTCAC CAAGCCAAAG TGGAACGTTA AATGCAGTAT TTTCAAACGA TCCGATTATC
ACNGCTTTTA TTGGTACAAA CAGAGTCAAT GGTAAGGATG TTAAAACACG CTTAACGATT
AAGTTCTTTG ATGCGTCAGG TAAAGAAGTA CTACCAGATA AAGATAGTCC ATTTGCGTAT
GCGCTGTCTT CTTTAAATTC AAGTTTAACG AATAAAGGTG GCCATGCCGA ATTTGTTTCT
GATTTTGGGG CNAACAATGC GTTCAAATAC ATTAATGGNT CNTATGTGAA AAAACAAGCG
GATGGAAAAT TTTACTCACC GGAAGATATT GACTATGGCA CAGGACCTTC TGGATTGAAA
AATAGTGATT GGGACGCTGT AGGTCACAAG AATGCCTACT TTGGTTCAGG TGTAGGTCTA
GCNAATGGNC GTATTTCCTT TTCTTTTGGT ATGACAACAA AAGGAAAAAG TAATGTGCCT
GTATCTAGTG CGCAATGGTT TGCCTTTAGN ACTAACTTAA ATGCGCAATC AGTGAAGCCT
ATTTTCAATT ATGGGAATCC AAAAGAACCA GAAAAGCAA CGATTGAATT CAATNGATAC
AAAGCCAATG TCGTTCCTGT NCTTGTGCCN AATAAAGAAG TCACTGATGG NCAGAAAAAT
NTCAATGATT TAAATGTGAA NCGTGGCGAT TCTTTACAAT ACATTGTGAC AGGGGATACG
ACAGAACTTG CCAAAGTAGA TCCAAAAACA GTAACNAAAC AAGGGATTCG AGATACNTTT
GATGCAGAAA AAGTGACGAT TGATTTATCC AAAGTGAAAG TTTATCAAGC AGACGCAAGT
CTNAACGANA AAGACTNAAA AGCTGTTGCT GCAGCNATTA ATTCAGGAAN AGCTAAAGAC
GTGACTGCTT CTTATGANCT CAATTTAGAT CAAAACACCG TCACAGCAAT GATGAAAACC
AACGCNGACG GNTCNGTTGT TTTAGCAATG GGGTATAAAT ATTTACTTGT CTTGCCGTTT
GTAGTGAAAA ATGTAGAAGG CGATTTTGAA AATACAGCTG TTCAGCTGAC AAANGATGGN
GAAACGGTAA CAAATACAGT GATTAACCAT GTGCCAGGTA GTAATCCTTC CAAAGATGTA
AAAGCAGATA AAAACGGTAC AGTTGGCAGT GTTTCTCTAC ATGATAAAGA TATTCCGTTA
CAAACAAAAA TTTATTATGA AGTGAAATCT TCCGAACGTC CAGCNAACTA TGGCGGAATN
ACNGAAGAAT GGGGCATGAA TGATGTCTTG GACACGACCC ATGATCGTTT CACAGGNAAA
```

TABLE 1-continued

Nucleotide and Amino Acid Seqeuences of *E. faecalis* Genes.

```
TGGCACGCTA TTACNAANTA TGACCTTAAA GTAGGGGANA AAACGTTAAA AGCAGGAACA
GATATTTCTG CCTACATTCT TTTAGAAAAC AAAGACAATA AAGACTTGAC GTTTACNATG
AATCAAGCAT TATTGGCNGC NTTAAATGAA GGAAGCAATA AAGTAGGCAA ACAAGCTTGG
TCTGTGTATC TGGAAGTCGA ACGGATNAAA ACAGGTGACG TAGAAAACAC GCAAACAGAA
AACTACAACA AAGAGCTTGT NCGTTCTAAT ACNGTGGTGA CGCATACNCC TGATGATCCA
AAACCAACCA AAGCCGTTCA TAACAAGAAA GGGGAAGANA TTAANCATGG AAAAGTNGCT
CGTGGTGATG TTCTTTCTTA TGAAATGACN TGGGACTTAA AAGGGTACGA TAAAGACTTT
GCCTTTGATA CAGTCGATCT TGCGACAGGC GTTTCTTTCT TCGATGATTA CGATGAAACG
AANGTGACAC CAATCAAAGA CTTACTTCGT GTCAAAGATT CTAAAGGGGN AGACATTACG
AACCAGTTCA CGATCTCNTG GGACGATGCC AAAGGCACGG TGACNATNTC TGCCAAAGAC
CCACAAGCCT TTATTCTAGC GNATGGTGGG CAAGAATTGC GTGTAACNCT CCCTACAAAA
GTCAAAGCCG ATGTTTCTGG NGATGTTTAT AATTCAGCGG AACAAAATAC ATTTGGNCAA
CGAATTAAAA CCAATACNGT TGTCAACCAT ATTCCAAAAG TGAANCCTAA AAAAGACGTG
GTTATTAAAG TNGGTGACAA ACAAAGTCAA AATGGNGCCA CAATCAAATT AGGGGAGAAN
TTCTTCTATG AATTTACAAG TAGTGACATT CCTGCAGAAT ACGCTGGNGT TGTGGAAGAA
TGGTCGATTA GCGATAAACT AGACGTCAAA CATGACAAAT TTAGTGGCCA ATGGTCTGTG
TTTGCCAATT CTAATTTTGT TTTAGCAGAC GGAACCAAAG TGAATAAAGG GGACGACATT
TCGAAACTAT TCACGATGAC CTTTGAACAA GGGGTAGTGA AAATCACGGC CAGTCAAGCC
TTTTTNGATG CGATGAATCT AAAAGAAAAC AAAAACGTTG CACACTCATG GAAAGCGTTC
ATTGGTGTAG AACGAATTGC GGCAGGAGAC GTTTACAACA CAATCGAAGA ATCTTTCAAC
AATGAGAAGA TTAAAACNAA TACGGTAGTG ACNCATCACG CAGAAAAACC ACAAACNCCA
CCAGAAAAAA CAGTGATTGT ACCACCAACA CCAAAAACAC CGCAAGCACC AGTAGAGCCA
TTAGTGGTAG AAAAGGCAAG TGTNGTGCCA GAATTGCCGC AAACAGGCGA AAAACAAAAT
GTCTTATTAA CGGTAGCTGG TAGTTTAGCC GCAATGCTTG GCTTAGCAGG CTTAGGCTTT
AAACGTAGAA AAGAAACAAA ATAA

EF062-2 (SEQ ID NO:234)
MKAKK QYKTYKAKNH WVTVPILFLS VLGAVGLATD NVQAAELDTQ PETTTVQPNN
PDLQSEKETP KTAVSEEATV QKDTTSQPTK VEEVAPENKG TEQSSATPND TTNAQQPTVG
AEKSAQEQPV VSPETTNEPL GQPTEVAPAE NEVNKSTSIP KEFETPDVDK AVDEVKKDPN
ITVVEKPAED LGNVSSKDLA AKEKEVDQLQ KEQAKKIAQQ AAELKAKNEK IAKENAEIAA
KNKAEKERXX KEVAEYNKHK NENSYVNEAI SKNLVFDQSV VTKDTKISSI KGGKFIKATD
FNKVNAGDSK DIFTKLRKDM GGKXTGNFQN SFVKEANLGS NGGYAVLLEK NKPVTVTYTG
LANSYLGRKI TKAEFVYELQ SSPSQSGTLN AVFSNDPIIT AFIGTNRVNG KDVKTRLTIK
FFDASGKEVL PDKDSPFAYA LSSLNSSLTN KGGHAEFVSD FGANNAFKYI NGSYVKKQAD
GKFYSPEDID YGTGPSGLKN SDWDAVGHKN AYFGSGVGLA NGRISFSFGM TTKGKSNVPV
SSAQWFAFXT NLNAQSVKPI FNYGNPKEPE KATIEFNXYK ANVVPVLVPN KEVTDGQKNX
NDLNVXRGDS LQYIVTGDTT ELAKVDPKTV TKQGIRDTFD AEKVTIDLSK VKVYQADASL
NXKDXKAVAA AINSGXAKDV TASYXLNLDQ NTVTAMMKTN ADGSVVLAMG YKYLLVLPFV
VKNVEGDFEN TAVQLTXDGE TVTNTVINHV PGSNPSKDVK ADKNGTVGSV SLHDKDIPLQ
TKIYYEVKSS ERPANYGGXT EEWGMNDVLD TTHDRFTGKW HAITXYDLKV GXKTLKAGTD
ISAYILLENK DNKDLTFTMN QALLAALNEG SNKVGKQAWS VLYEVERXKT GDVENTQTEN
YNKELVRSNT VVTHTPDDPK PTKAVHNKKG EXIXHGKVAR GDVLSYEMTW DLKGYDKDFA
FDTVDLATGV SFFDDYDETX VTPIKDLLRV KDSKGXDITN QFTISWDDAK GTVTXSAKDP
QAFILAXGGQ ELRVTLPTKV KADVSGDVYN SAEQNTFGQR IKTNTVVNHI PKVXPKKDVV
IKVGDKQSQN GATIKLGEXF FYEFTSSDIP AEYAGVVEEW SISDKLDVDH DKFSGQWSVF
ANSNFVLADG TKVNKGDDIS KLFTMTFEQG VVKITASQAF XDAMNLKENK NVAHSWKAFI
GVERIAAGDV YNTIEESFNN EKIKTNTVVT HTPEKPQTPP EKTVIVPPTP KTPQAPVEPL
VVEKASVVPE LPQTGEKQNV LLTVAGSLAA MLGLAGLGFK RRKETK

EFO62-3 (SEQ ID NO;235)
TGATTCTTGA AGCAACAAAT GAAAGCAAAA AAACAATATA AGACATATAA AGCTAAGAAT
CACTGGGTAA CTGTCCCTAT TCTTTTTCTA AGTGTGTTAG GAGCCGTAGG ATTAGCTACT
GATAATGTAC AAGCCGCGGA ATTAGATACG CAACCAGAAA CAACGACGGT TCAACCCAAT
AACCCCGACC TGCAGTCAGA AAAGGAAACA CCTAAAACGG CAGTATCTGA AGAAGCAACA
GTACAAAAAG ACACTACTTC TCAACCGACC AAAGTAGAAG AAGTAGCGCC AGAAAATAAA
GGTACTGAAC AAAGTTCAGC TACCCCAAAT GATACCACAA ACGCGCAACA ACCAACAGTA
GGAGCTGAAA AATCAGCACA AGAACAACCA GTAGTAAGCC CTGAAACAAC CAATGAACCT
CTAGGGCAGC CAACAGAAGT TGCACCAGCT GAAAATGAAG TGAATAAATC AACGTCCATT
CCTAAAGAAT TTGAAACACC AGACGTTGAT AAAGCAGTTG ATGAAGTAAA AAAAGATCCA
AACATTACCG TTGTTGAAAA ACCAGCAGAA GACTTAGGCA ACGTTTCTTC TAAAGATTTA
GCTGCAAAAG AAAAAGAAGT AGACCAACTA CAAAAAGAAC AAGCGAAAAA GATTGCCCAA
CAAGCAGCTG AATTAAAAGC CAAAAATGAA AAAATTGCCA AAGAAAATGC AGAAATTGCG
GCAAAAAACA AAGCNGAAAA AGAGCGNTAN GANAAAGAAG TCGCNGAATA CAACAAGCAT
AAGAACGAAA ACAGCTATGT CAATGAAGCG ATTAGTAAAA ACCTAGTGTT CGATCAATCT
GTCGTGACGA AAGACACTAA AATTTCGTCG ATTAAAGGCG GAAAATTTAT CAAAGCAACT
GATTTTAATA AAGTAAATGC AGGGGATTCA AAAGATATCT TTACAAAATT ACGGAAAGAT
ATGGGNGGGA AAGNTACTGG CAACTTCCAG AATTCCTTTG TAAAAGAGGC AAATCTTGGG
TCTAATGGTG GTATGCGGT TCTTTTAGAA AAAAATAAAC CAGTGACAGT GACCTATACA
GGACTAAACG CTAGTTATTT AGGACGTAAA ATTACAAAAG CAGAATTTGT TTATGAACTA
CAATCCTCAC CAAGCCAAAG TGGAACGTTA AATGCAGTAT TTTCAAACGA TCCGATTATC
ACNGCTTTTA TTGGTACAAA CAGAGTCAAT GGTAAGGATG TTAAAACACG CTTAACGATT
AAGTTCTTTG ATGCGTCAGG TAAAGAAGTA CTACCAGATA AAGATAGTCC ATTTGCGTAT
GCGCTGTCTT CTTTAAATTC AAGTTTAACG AATAAAGGTG GCCATGCGGA ATTTGTTTCT
GATTTTGGGG CNAACAATGC GTTCAAATAC ATTAATGGNT CNTATGTGAA AAAACAAGCG
GATGGAAAAT TTTACTCACC GGAAGATATT GACTATGCA CAGGACCTTC TGGATTGAAA
AATAGTGATT GGGACGCTGT AGGTCACAAG AATGCCTACT TTGGTTCAGG TGTAGGTCTA
```

TABLE 1-continued

Nucleotide and Amino Acid Seqeuences of *E. faecalis* Genes.

```
GCNAATGGNC GTATTTCCTT TTCTTTTGGT ATGACAACAA AAGGAAAAAG TAATGTGCCT
GTATCTAGTG CGCAATGGTT TGCCTTTAGN ACTAACTTAA ATGCGCAATC AGTGAAGCCT
ATTTTCAATT ATGGGAATCC AAAAGAACCA GAAAAGCAA CGATTGAATT CAATNGATAC
AAAGCCAATG TCGTTCCTGT NCTTGTGCCN AATAAAGAAG TCACTGATGG NCAGAAAAAT
NTCAATGATT TAAATGTGAA NCGTGGCGAT TCTTTACAAT ACATTGTGAC AGGGGATACG
ACAGAACTTG CCAAAGTAGA TCCAAAAACA GTAACAAAAC AAGGGATTCG AGATACNTTT
GATGCAGAAA AAGTGACGAT TGATTTATCC AAAGTGAAAG TTTATCAAGC AGACGCAAGT
CTNAACGANA AAGACTNAAA AGCTGTTGCT GCAGCNATTA ATTCAGGAAN AGCTAAAGAC
GTGACTGCTT CTTATGANCT CAATTTAGAT CAAAACACCG TCACAGCAAT GATGAAAACC
AACGCNGACG GNTCNGTTGT TTTAGCAATG GGGTATAAAT ATTTACTTGT CTTGCCGTTT
GTAGTGAAAA ATGTAGAAGG CGATTTTGAA AATACAGCTG TTCAGCTGAC AAANGATGGN
GAAACGGTAA CAAATACAGT GATTAACCAT GTGCCAGGTA GTAATCCTTC CAAAGATGTA
AAAGCAGATA AAAACGGTAC AGTTGGCAGT GTTTCTCTAC ATGATAAAGA TATTCCGTTA
CAAACAAAAA TTTATTATGA AGTGAAATCT TCCGAACGTC CAGCNAACTA TGGCGGAATN
ACNGAAGAAT GGGGCATGAA TGATGTCTTG GACACGACCC ATGATCGTTT CACAGGNAAA
TGGCACGCTA TTACNAANTA TGACCTTAAA GTAGGGGANA AAACGTTAAA AGCAGGAACA
GATATTTCTG CCTACATTCT TTTAGAAAAC AAAGACAATA AAGACTTGAC GTTTACNATG
AATCAAGCAT TATTGGCNGC NTTAAATGAA GGAAGCAATA AGTAGGCAA ACAAGCTTGG
TCTGTGTATC TGGAAGTCGA ACGGATNAAA ACAGGTGACG TAGAAAACAC GCAAACAGAA
AACTACAACA AAGAGCTTGT NCGTTCTAAT ACNGTGGTGA CGCATACNCC TGATGATCCA
AAACCAACCA AAGCCGTTCA TAACAAGAAA GGGGAAGANA TTAANCATGG AAAAGTNGCT
CGTGGTGATG TTCTTTCTTA TGAAATGACN TGGGACTTAA AAGGGTACGA TAAAGACTTT
GCCTTTGATA CAGTCGATCT TGCGACAGGC GTTTCTTTCT TCGATGATTA CGATGAAACG
AANGTGACAC CAATCAAAGA CTTACTTCGT GTCAAAGATT CTAAAGGGGN AGACATTACG
AACCAGTTCA CGATCTCNTG GGACGATGCC AAAGGCACGG TGACNATNTC TGCCAAAGAC
CCACAAGCCT TTATTCTAGC GNATGGTGGG CAAGAATTGC GTGTAACNCT CCCTACAAAA
GTCAAAGCCG ATGTTTCTGG NGATGTTTAT AATTCAGCGG AACAAAATAC ATTTGGNCAA
CGAATTAAAA CCAATACNGT TGTCAACCAT ATTCCAAAAG TGAANCCTAA AAAAGACGTG
GTTATTAAAG TNGGTGACAA ACAAAGTCAA AATGGGNCCA CAATCAAATT AGGGGAGAAN
TTCTTCTATG AATTTACAAG TAGTGACATT CCTGCAGAAT ACGCTGGNGT TGTGGAAGAA
TGGTCGATTA GCGATAAACT AGACGTCAAA CATGACAAAT TTAGTGGCCA ATGGTCTGTG
TTTGCCAATT CTAATTTTGT TTTAGCAGAC GGAACCAAAG TGAATAAAGG GGACGACATT
TCGAAACTAT TCACGATGAC CTTTGAACAA GGGGTAGTGA AAATCACGGC CAGTCAAGCC
TTTTTNGATG CGATGAATCT AAAAGAAAAC AAAAACGTTG CACACTCATG GAAAGCGTTC
ATTGGTGTAG AACGAATTGC GGCAGGAGAC GTTTACAACA CAATCGAAGA ATCTTTCAAC
AATGAGAAGA TTAAAACNAA TACGGTAGTG ACNCATACGC CAGAAAAACC ACAAACNCCA
CCAGAAAAAA CAGTGATTGT ACCACCAACA CCAAAAACAC CGCAAGCACC AGTAGAGCCA
TTAGTGGTAG AAAAGGCAAG TG
```

EF062-4 (SEQ ID NO:236)
```
AELDTQ PETTTVQPNN
PDLQSEKETP KTAVSEEATV QKDTTSQPTK VEEVAPENKG TEQSSATPND TTNAQQPTVG
AEKSAQEQPV VSPETTNEPL GQPTEVAPAE NEVNKSTSIP KEFETPDVDK AVDEVKKDPN
ITVVEKPAED LGNVSSKDLA AKEKEVDQLQ KEQAKKIAQQ AAELKAKNEK IAKENAEIAA
KNKAEKERXX KEVAEYNKHK NENSYVNEAI SKNLVFDQSV VTKDTKISSI KGGKFIKATD
FNKVNAGDSK DIFTKLRKDM GGKXTGNFQN SFVKEANLGS NGGYAVLLEK NKPVTVTYTG
LNASYLGRKI TKAEFVYELQ SSPSQSGTLN AVFSNDPIIT AFIGTNRVNG KDVKTRLTIK
FFDASGKEVL PDKDSPFAYA LSSLNSSLTN KGGHAEFVSD FGANNAFKYI NGSYVKKQAD
GKFYSPEDID YGTGPSGLKN SDWDAVGHKN AYFGSGVGLA NGRISFSFGM TTKGKSNVPV
SSAQWFAFXT NLNAQSVKPI FNYGNPKEPE KATIEFNXYK ANVVPVLVPN KEVTDGQKNX
NDLNVXRGDS LQYIVTGDTT ELAKVDPKTV TKQGIRDTFD AEKVTIDLSK VKVYQADASL
NXKDXKAVAA AINSGXAKDV TASYXLNLDQ NTVTAMMKTN ADGSVVLAMG YKYLLVLPFV
VKNVEGDFEN TAVQLTXDGE TVTNTVINHV PGSNPSKDVK ADKNGTVGSV SLHDKDIPLQ
TKIYYEVKSS ERPANYGGXT EEWGMNDVLD TTHDRFTGKW HAITXYDLKV GXKTLKAGTD
ISAYILLENK DNKDLTFTMN QALLAALNEG SNKVGKQAWS VYLEVERXKT GDVENTQTEN
YNKELVRSNT VVTHTPDDPK PTKAVHNKKG EXIXHGKVAR GDVLSYEMTW DLKGYDKDFA
FDTVDLATGV SFFDDYDETX VTPIKDLLRV KDSKGXDITN QFTISWDDAK GTVTXSAKDP
QAFILAXGGQ ELRVTLPTKV KADVSGDVYN SAEQNTFGQR IKTNTVVNHI PKVXPKKDW
IKVGDKQSQN GATIKLGEXF FYEFTSSDIP AEYAGWEEVV SISDKLDVKH DKFSGQWSVF
ANSNFVLADG TKVNKGDDIS KLFTMTFEQG VVKITASQAF XDAMNLKENK NVAHSWKAFI
GVERIAAGDV YNTIEESFNN EKIKTNTVVT HTPEKPQTPP EKTVIVPPTP KTPQAPVEPL
VVEKASV
```

EF063-1 (SEQ ID NO:237)
```
TGATTCTTGA AGCAACAAAT GAAAGCAAAA AAACAATATA AGACATATAA AGCTAAGAAT
CACTGGGTAA CTGTCCCTAT TCTTTTTCTA AGTGTGTTAG GAGCCGTAGG ATTAGCTACT
GATAATGTAC AAGCCGCGGA ATTAGATACG CAACCAGAAA CAACGACGGT TCAACCCAAT
AACCCCGACC TGCAGTCAGA AAAGGAAACA CCTAAAACGG CAGTATCTGA AGAAGCAACA
GTACAAAAAG ACACTACTTC TCAACCGACC AAAGTAGAAG AAGTAGCGCC AGAAAATAAA
GGTACTGAAC AAAGTTCAGC TACCCCAAAT GATACCACAA ACGCGCAACA ACCAACAGTA
GGAGCTGAAA AATCAGCACA AGAACAACCA GTAGTAAGCC CTGAAACAAC CAATGAACCT
CTAGGGCAGC CAACAGAAGT TGCACCAGCT GAAAATGAAG TGAATAAATC AACGTCCATT
CCTAAAGAAT TTGAAACACC AGACGTTGAT AAAGCAGTTG ATGAAGTAAA AAAAGATCCA
AACATTACCG TTGTTGAAAA ACCAGCAGAA GACTTAGGCA ACGTTTCTTC TAAAGATTTA
GCTGCAAAAG AAAAAGAAGT AGACCAACTA CAAAAAGAAC AAGCGAAAAA GATTGCCCAA
CAAGCAGCTG AATTAAAAGC CAAAAATGAA AAATTTGCCA AAGAAAATGC AGAAATTGCG
GCAAAAAACA AAGCNGAAAA AGAGCGNTAN GANAAAGAAG TCGCNGAATA CAACAAGCAT
```

TABLE 1-continued

Nucleotide and Amino Acid Seqeuences of E. faecalis Genes.

```
AAGAACGAAA ACAGCTATGT CAATGAAGCG ATTAGTAAAA ACCTAGTGTT CGATCAATCT
GTCGTGACGA AAGACACTAA AATTTCGTCG ATTAAAGGCG GAAAATTTAT CAAAGCAACT
GATTTTAATA AAGTAAATGC AGGGGATTCA AAAGATATCT TTACAAAATT ACGGAAAGAT
ATGGGNGGGA AAGNTACTGG CAACTTCCAG AATTCCTTTG TAAAAGAGGC AAATCTTGGG
TCTAATGGTG GGTATGCGGT TCTTTTAGAA AAAAATAAAC CAGTGACAGT GACCTATACA
GGACTAAACG CTAGTTATTT ACGACGTAAA ATTACAAAAG CAGAATTTCT TTATGAACTA
CAATCCTCAC CAAGCCAAAG TGGAACGTTA AATGCAGTAT TTTCAAACGA TCCGATTATC
ACNGCTTTTA TTGGTACAAA CAGAGTCAAT GGTAAGGATG TTAAAACACG CTTAACGATT
AAGTTCTTTA ATGCGTCAGG TAAAGAAGTA CTACCAGATA AAGATAGTCC ATTTCCCTAT
GCGCTGTCTT CTTTAAATTC AAGTTTAACG AATAAAGGTG GCCATGCGGA ATTTGTTTCT
GATTTTGGGG CNAACAATGC GTTCAAATAC ATTAATGGNT CNTATGTGAA AAAACAAGCG
GATGGAAAAT TTTACTCACC GGAAGATATT GACTATGGCA CAGGACCTTC TGGATTGAAA
AATAGTGATT GGGACGCTGT AGGTCACAAG AATGCCTACT TTGGTTCAGG TGTAGGTCTA
GCNAATGGNC GTATTTCCTT TTCTTTTGGT ATGACAACAA AAGGAAAAAG TAATGTGCCT
GTATCTAGTG CGCAATGGTT TGCCTTTAGN ACTAACTTAA ATGCGCAATC AGTGAAGCCT
ATTTTCAATT ATGGGAATCC AAAAGAACCA GAAAAGCAA CGATTGAATT CAATNGATAC
AAAGCCAATG TCGTTCCTGT NCTTGTGCCN AATAAAGAAG TCACTGATGG NCAGAAAAAT
NTCAATGATT TAAATGTGAA NCGTGGCGAT TCTTTACAAT ACATTGTGAC AGGGGATACG
ACAGAACTTG CCAAAGTAGA TCCAAAAACA GTAACNAAAC AAGGGATTCG AGATACNTTT
GATGCAGAAA AAGTGACGAT TGATTTATCC AAAGTGAAAG TTTATCAAGC AGACGCAAGT
CTNAACGANA AAGACTNAAA AGCTGTTGCT GCAGCNATTA ATTCAGGAAN AGCTAAAGAC
GTGACTGCTT CTTATGANCT CAATTTAGAT CAAAACACCG TCACAGCAAT GATGAAAACC
AACGCNGACG GNTCGTTGT TTTAGCAATG GGGTATAAAT ATTTACTTGT CTTGCCGTTT
GTAGTGAAAA ATGTAGAAGG CGATTTTGAA AATACAGCTG TTCAGCTGAC AAANGATGGN
GAAACGGTAA CAAATACAGT GATTAACCAT GTGCCAGGTA GTAATCCTTC CAAAGATGTA
AAAGCAGATA AAAACGGTAC AGTTGGCAGT GTTTCTCTAC ATGATAAAGA TATTCCGTTA
CAAACAAAAA TTTATTATGA AGTGAAATCT TCCGAACGTC CAGCNAACTA TGGCGGAATN
ACNGAAGAAT GGGGCATGAA TGATGTCTTG GACACGACCC ATGATCGTTT CACAGGNAAA
TGGCACGCTA TTACNAANTA TGACCTTAAA GTAGGGGANA AAACGTTAAA AGCAGGAACA
GATATTCTG CCTACATTCT TTTAGAAAAC AAAGACAATA AAGACTTGAC GTTTACNATG
AATCAAGCAT TATTGGCNGC NTTAAATGAA GGAAGCAATA AAGTAGGCAA ACAAGCTTGG
TCTGTGTATC TGGAAGTCGA ACGGATNAAA ACAGGTGACG TAGAAAACAC GCAAACAGAA
AACTACAACA AAGAGCTTGT NCGTTCTAAT ACNGTGGTGA CGCATACNCC TGATGATCCA
AAACCAACCA AAGCCGTTCA TAACAAGAAA GGGGAAGANA TTAANCATGG AAAAGTNGCT
CGTGGTGATG TTCTTTCTTA TGAAATGACN TGGGACTTAA AAGGGTACGA TAAAGACTTT
GCCTTTGATA CAGTCGATCT TGCGACAGGC GTTTCTTTCT TCGATGATTA CGATGAAACG
AANGTGACAC CAATCAAAGA CTTACTTCGT GTCAAAGATT CTAAAGGGGN AGACATTACG
AACCAGTTCA CGATCTCNTG GGACGATGCC AAAGGCACGG TGACNATNTC TGCCAAAGAC
CCACAAGCCT TTATTCTAGC GNATGGTGGG CAAGAATTGC GTGTAACNCT CCCTACAAAA
GTCAAAGCCG ATGTTCTGG NGATGTTTAT AATTCAGCGG AACAAATAC ATTTGGNCAA
CGAATTAAAA CCAATACNGT TGTCAACCAT ATTCCAAAAG TGAANCCTAA AAAAGACGTG
GTTATTAAAG TNGGTGACAA ACAAAGTCAA AATGGNGCCA CAATCAAATT AGGGGAGAAN
TTCTTCTATG AATTTACAAG TAGTGACATT CCTGCAGAAT ACGCTGGNGT TGTGGAAGAA
TGGTCGATTA GCGATAAACT AGACGTCAAA CATGACAAAT TTAGTGGCCA ATGGTCTGTG
TTTGCCAATT CTAATTTTGT TTTAGCAGAC GGAACCAAAG TGAATAAAGG GGACGACATT
TCGAAACTAT TCACGATGAC CTTTGAACAA GGGGTAGTGA AAATCACGGC CAGTCAAGCC
TTTTTNGATG CGATGAATCT AAAAGAAAAC AAAAACGTTG CACACTCATG GAAAGCGTTC
ATTGGTGTAG AACGAATTGC GGCAGGAGAC GTTTACAACA CAATCGAAGA ATCTTTCAAC
AATGAGAAGA TTAAAACNAA TACGGTAGTG ACNCATACGC CAGAAAAACC ACAAACNCCA
CCAGAAAAAA CAGTGATTGT ACCACCAACA CCAAAAACAC CGCAAGCACC AGTAGAGCCA
TTAGTGGTAG AAAAGGCAAG TGTNGTGCCA GAATTGCCGC AACAGGCGA AAAACAAAAT
GTCTTATTAA CGGTAGCTGG TAGTTTAGCC GCAATGCTTG GCTTAGCAGG CTTAGGCTTT
AAACGTAGAA AAGAAACAAA ATAA

EF063-2 (SEQ ID NO:238)
MKAKK QYKTYKAKNH WVTVPILFLS VLGAVGLATD NVQAAELDTQ PETTTVQPNN
PDLQSEKETP KTAVSEEATV QKDTTSQPTK VEEVAPENKG TEQSSATPND TTNAQQPTVG
AEKSAQEQPV VSPETTNEPL GQPTEVAPAE NEVNKSTSIP KEFETPDVDK AVDEVKKDPN
ITVVEKPAED LGNVSSKDLA AKEKEVDQLQ KEQAKKIAQQ AAELKAKNEK IAKENAEIAA
KNKAEKERXX KEVAEYNKHK NENSYVNEAI SKNLVFDQSV VTKDTKISSI KGGKFIKATD
FNKVNAGDSK DIFTKLRKDM GGKXTGNFQN SFVKEANLGS NGGYAVLLEK NKPVTVTYTG
LNASYLGRKI TKAEFVYELQ SSPSQSGTLN AVFSNDPIIT AFIGTNRVNG KDVKTRLTIK
FFDASGKEVL PDKDSPFAYA LSSLNSSLTN KGGHAEFVSD FGANNAFKYI NGSYVKKQAD
GKFYSPEDID YGTGPSGLKN SDWDAVGHKN AYFGSGVGLA NGRISFSFGM TTKGKSNVPV
SSAQWFAFXT NLNAQSVKPI FNYGNPKEPE KATIEFNXYK ANVVPVLVPN KEVTDGQKNX
NDLNVXRGDS LQYIVTGDTT ELAKVDPKTV TKQGIRDTFD AEKVTIDLSK VKVYQADASL
NXKDXKAVAA AINSGXAKDV TASYXLNLDQ NTVTAMMKTN ADGSVVLAMG YKYLLVLPFV
VKNVEGDFEN TAVQLTXDGE TVTNTVINHV PGSNPSKDVK ADKNGTVGSV SLHDKDIPLQ
TKIYYEVKSS ERPANYGGXT EEWGMNDVLD TTHDRFTGKW HAITXYDLKV GXKTLKAGTD
ISAYILLENK DNKDLTFTMN QALLAALNEG SNKVGKQAWS VYLEVERXKT GDVENTQTEN
YNKELVRSNT VVTHTPDDPK PTKAVHNKKG EXIXHGKVAR GDVLSYEMTW DLKGYDKDFA
FDTVDLATGV SFFDDYDETX VTPIKDLLRV KDSKGXDITN QFTISWDDAK GTVTXSAKDP
QAFILAXGGQ ELRVTLPTKV KADVSGDVYN SAEQNTFGQR IKTNTVVNHI PKVXPKKDVV
IKVGDKQSQN GATIKLGEXF FYEFTSSDIP AEYAGVVEEW SISDKLDVKH DKFSGQWSVF
ANSNFVLADG TKVNKGDDIS KLFTMTFEQG VVKITASQAF XDAMNLKENK NVAHSWKAFI
GVERIAAGDV YNTIEESFNN EKIKTNTVVT HTPEKPQTPP EKTVIVPPTP KTPQAPVEPL
VVEKASVVPE LPQTGEKQNV LLTVAGSLAA MLGLAGLGFK RRKETK
```

TABLE 1-continued

Nucleotide and Amino Acid Seqeuences of E. faecalis Genes.

EF063-3 (SEQ ID NO.239)
GGA ATTAGATACG CAACCAGAAA CAACGACGGT TCAACCCAAT
AACCCCGACC TGCAGTCAGA AAAGGAAACA CCTAAAACGG CAGTATCTGA AGAAGCAACA
GTACAAAAAG ACACTACTTC TCAACCGACC AAAGTAGAAG AAGTAGCGCC AGAAAATAAA
GGTACTGAAC AAAGTTCAGC TACCCCAAAT GATACCACAA ACGCGCAACA ACCAACAGTA
GGAGCTGAAA AATCAGCACA AGAACAACCA GTAGTAAGCC CTGAAACAAC CAATGAACCT
CTAGGGCAGC CAACAGAAGT TGCACCAGCT GAAAATGAAG TGAATAAATC AACGTCCATT
CCTAAAGAAT TTGAAACACC AGACGTTGAT AAAGCAGTTG ATGAAGTAAA AAAAGATCCA
AACATTACCG TTGTTGAAAA ACCAGCAGAA GACTTAGGCA ACGTTTCTTC TAAAGATTTA
GCTGCAAAAG AAAAAGAAGT AGACCAACTA CAAAAAGAAC AAGCGAAAAA GATTGCCCAA
CAAGCAGCTG AATTAAAAGC CAAAAATGAA AAAATTGCCA AGAAAAATGC AGAAATTGCG
GCAAAAAACA AAGCNGAAAA AGAGCGNTAN GANAAAGAAG TCGCNGAATA CAACAAGCAT
AAGAACGAAA ACAGCTATGT CAATGAAGCG ATTAGTAAAA ACCTAGTGTT CGATCAATCT
GTCGTGACGA AAGACACTAA AATTTCGTCG ATTAAAGGCG GAAAATTTAT CAAAGCAACT
GATTTTAATA AAGTAAATGC AGGGGATTCA AAAGATATCT TTACAAAATT ACGGAAAGAT
ATGGGNGGGA AAGNTACTGG CAACTTCCAG AATTCCTTTG TAAAAGAGGC AAATCTTGGG
TCTAATGGTG GGTATGCGGT TCTTTTAGAA AAAAATAAAC CAGTGACAGT GACCTATACA
GGACTAAACG CTAGTTATTT AGGACGTAAA ATTACAAAAG CAGAATTTGT TTATGAACTA
CAATCCTCAC CAAGCCAAAG TGGAACGTTA AATGCAGTAT TTTCAAACGA TCCGATTATC
ACNGCTTTTA TTGGTACAAA CAGAGTCAAT GGTAAGGATG TTAAAACACG CTTAACGATT
AAGTTCTTTG ATGCGTCAGG TAAAGAAGTA CTACCAGATA AAGATAGTCC ATTTGCGTAT
GCGCTGTCTT CTTTAAATTC AAGTTTAACG AATAAAGGTG GCCATGCGGA ATTTGTTTCT
GATTTTGGGG CNAACAATGC GTTCAAATAC ATTAATGGNT CNTATGTGAA AAAACAAGCG
GATGGAAAAT TTTACTCACC GGAAGATATT GACTATGGCA CAGGACCTTC TGGATTGAAA
AATAGTGATT GGGACGCTGT AGGTCACAAG AATGCCTACT TTGGTTCAGG TGTAGGTCTA
GCNAATGGNC GTATTTCCTT TTCTTTTGGT ATGACAACAA AAGGAAAAAG TAATGTGCCT
GTATCTAGTG CGCAATGGTT TGCCTTTAGN ACTAACTTAA ATGCGCAATC AGTGAAGCCT
ATTTTCAATT ATGGGAATCC AAAAGAACCA GAAAAAGCAA CGATTGAATT CAATNGATAC
AAAGCCAATG TCGTTCCTGT NCTTGTGCCN AATAAAGAAG TCACTGATGG NCAGAAAAAT
NTCAATGATT TAAATGTGAA NCGTGGCGAT TCTTTACAAT ACATTGTGAC AGGGGATACG
ACAGAACTTG CCAAAGTAGA TCCAAAAACA GTAACNAAAC AAGGGATTCG AGATACNTTT
GATGCAGAAA AAGTGACGAT TGATTTATCC AAAGTG

EF063-4 (SEQ ID NO:240)
ELDTQ PETTTVQPNN
PDLQSEKETP KTAVSEEATV QKDTTSQPTK VEEVAPENKG TEQSSATPND TTNAQQPTVG
AEKSAQEQPV VSPETTNEPL GQPTEVAPAE NEVNKSTSIP KEFETPDVDK AVDEVKKDPN
ITWEKPAED LGNVSSKDLA AKEKEVDQLQ KEQAKKIAQQ AAELKAKNEK IAKENAEIAA
KNKAEKERXX KEVAEYNKHK NENSYVNEAI SKNLVFDQSV VTKDTKISSI KGGKFIKATD
FNKVNAGDSK DIFTKLRKDM GGKXTGNFQN SFVKEANLGS NGGYAVLLEK NKPVTVTYTG
LNASYLGRKI TKAEFVYELQ SSPSQSGTLN AVFSNDPIIT AFIGTNRVNG KDVKTRLTIK
FFDASGKEVL PDKDSPFAYA LSSLNSSLTN KGGHAEFVSD FGANNAFKYI NGSYVKKQAD
GKFYSPEDID YGTGPSGLKN SDWDAVGHKN AYFGSGVGLA NGRISFSFGM TTKGKSNVPV
SSAQWFAFXT NLNAQSVKPI FNYGNPKEPE KATIEFNXYK ANVVPVLVPN KEVTDGQKNX
NDLNVXRGDS LQYIVTGDTT ELAKVDPKTV TKQGIRDTFD AEKVTIDLSK V

EF064-1 (SEQ ID No:241)
TGATTCTTGA AGCAACAAAT GAAAGCAAAA AAACAATATA AGACATATAA AGCTAAGAAT
CACTGGGTAA CTGTCCCTAT TCTTTTTCTA AGTGTGTTAG GAGCCGTAGG ATTAGCTACT
GATAATGTAC AAGCCGCGGA ATTAGATACG CAACCAGAAA CAACGACGGT TCAACCCAAT
AACCCCGACC TGCAGTCAGA AAAGGAAACA CCTAAAACGG CAGTATCTGA AGAAGCAACA
GTACAAAAAG ACACTACTTC TCAACCGACC AAAGTAGAAG AAGTAGCGCC AGAAAATAAA
GGTACTGAAC AAAGTTCAGC TACCCCAAAT GATACCACAA ACGCGCAACA ACCAACAGTA
GGAGCTGAAA AATCAGCACA AGAACAACCA GTAGTAAGCC CTGAAACAAC CAATGAACCT
CTAGGGCAGC CAACAGAAGT TGCACCAGCT GAAAATGAAG TGAATAAATC AACGTCCATT
CCTAAAGAAT TTGAAACACC AGACGTTGAT AAAGCAGTTG ATGAAGTAAA AAAAGATCCA
AACATTACCG TTGTTGAAAA ACCAGCAGAA GACTTAGGCA ACGTTTCTTC TAAAGATTTA
GCTGCAAAAG AAAAAGAAGT AGACCAACTA CAAAAAGAAC AAGCGAAAAA GATTGCCCAA
CAAGCAGCTG AATTAAAAGC CAAAAATGAA AAAATTGCCA AGAAAAATGC AGAAATTGCG
GCAAAAAACA AAGCNGAAAA AGAGCGNTAN GANAAAGAAG TCGCNGAATA CAACAAGCAT
AAGAACGAAA ACAGCTATGT CAATGAAGCG ATTAGTAAAA ACCTAGTGTT CGATCAATCT
GTCGTGACGA AAGACACTAA AATTTCGTCG ATTAAAGGCG GAAAATTTAT CAAAGCAACT
GATTTTAATA AAGTAAATGC AGGGGATTCA AAAGATATCT TTACAAAATT ACGGAAAGAT
ATGGGNGGGA AAGNTACTGG CAACTTCCAG AATTCCTTTG TAAAAGAGGC AAATCTTGGG
TCTAATGGTG GGTATGCGGT TCTTTTAGAA AAAAATAAAC CAGTGACAGT GACCTATACA
GGACTAAACG CTAGTTATTT AGGACGTAAA ATTACAAAAG CAGAATTTGT TTATGAACTA
CAATCCTCAC CAAGCCAAAG TGGAACGTTA AATGCAGTAT TTTCAAACGA TCCGATTATC
ACNGCTTTTA TTGGTACAAA CAGAGTCAAT GGTAAGGATG TTAAAACACG CTTAACGATT
AAGTTCTTTG ATGCGTCAGG TAAAGAAGTA CTACCAGATA AAGATAGTCC ATTTGCGTAT
GCGCTGTCTT CTTTAAATTC AAGTTTAACG AATAAAGGTG GCCATGCGGA ATTTGTTTCT
GATTTTGGGG CNAACAATGC GTTCAAATAC ATTAATGGNT CNTATGTGAA AAAACAAGCG
GATGGAAAAT TTTACTCACC GGAAGATATT GACTATGGCA CAGGACCTTC TGGATTGAAA
AATAGTGATT GGGACGCTGT AGGTCACAAG AATGCCTACT TTGGTTCAGG TGTAGGTCTA
GCNAATGGNC GTATTTCCTT TTCTTTTGGT ATGACAACAA AAGGAAAAAG TAATGTGCCT
GTATCTAGTG CGCAATGGTT TGCCTTTAGN ACTAACTTAA ATGCGCAATC AGTGAAGCCT
ATTTTCAATT ATGGGAATCC AAAAGAACCA GAAAAAGCAA CGATTGAATT CAATNGATAC

TABLE 1-continued

Nucleotide and Amino Acid Seqeuences of *E. faecalis* Genes.

```
AAAGCCAATG TCGTTCCTGT NCTTGTGCCN AATAAAGAAG TCACTGATGG NCAGAAAAAT
NTCAATGATT TAAATGTGAA NCGTGGCGAT TCTTTACAAT ACATTGTGAC AGGGGATACG
ACAGAACTTG CCAAAGTAGA TCCAAAAACA GTAACNAAAC AAGGGATTCG AGATACNTTT
GATGCAGAAA AAGTGACGAT TGATTTATCC AAAGTGAAAG TTTATCAAGC AGACGCAAGT
CTNAACGANA AAGACTNAAA AGCTGTTGCT GCAGCNATTA ATTCAGGAAN AGCTAAAGAC
GTGACTGCTT CTTATGANCT CAATTTAGAT CAAAACACCG TCACAGCAAT GATGAAAACC
AACGCNGACG GNTCGTTGT TTTAGCAATG GGGTATAAAT ATTTACTTGT CTTGCCGTTT
GTAGTGAAAA ATGTAGAAGG CGATTTTGAA AATACAGCTG TTCAGCTGAC AAANGATGGN
GAAACGGTAA CAAATACAGT GATTAACCAT GTGCCAGGTA GTAATCCTTC CAAAGATGTA
AAAGCAGATA AAAACGGTAC AGTTGGCAGT GTTTCTCTAC ATGATAAAGA TATTCCGTTA
CAAACAAAAA TTTATTATGA AGTGAAATCT TCCGAACGTC CAGCNAACTA TGGCGGAATN
ACNGAAGAAT GGGGCATGAA TGATGTCTTG GACACGACCC ATGATCGTTT CACAGGNAAA
TGGCACGCTA TTACNAANTA TGACCTTAAA GTAGGGGANA AAACGTTAAA AGCAGGAACA
GATATTTCTG CCTACATTCT TTTAGAAAAC AAAGACAATA AAGACTTGAC GTTTACNATG
AATCAAGCAT TATTGGCNGC NTTAAATGAA GGAAGCAATA AAGTAGGCAA ACAAGCTTGG
TCTGTGTATC TGGAAGTCGA ACGGATNAAA ACAGGTGACG TAGAAAACAC GCAAACAGAA
AACTACAACA AAGAGCTTGT NCGTTCTAAT ACNGTGGTGA CGCATACNCC TGATGATCCA
AAACCAACCA AAGCCGTTCA TAACAAGAAA GGGGAAGANA TTAANCATGG AAAAGTNGCT
CGTGGTGATG TTCTTTCTTA TGAAATGACN TGGGACTTAA AAGGGTACGA TAAAGACTTT
GCCTTTGATA CAGTCGATCT TGCGACAGGC GTTTCTTTCT TCGATGATTA CGATGAAACG
AANGTGACAC CAATCAAAGA CTTACTTCGT GTCAAAGATT CTAAAGGGGN AGACATTACG
AACCAGTTCA CGATCTCNTG GGACGATGCC AAAGGCACGG TGACNATNTC TGCCAAAGAC
CCACAAGCCT TTATTCTAGC GNATGGTGGG CAAGAATTGC GTGTAACNCT CCCTACAAAA
GTCAAAGCCG ATGTTTCTGG NGATGTTTAT AATTCAGCGG AACAAAATAC ATTTGGNCAA
CGAATTAAAA CCAATACNGT TGTCAACCAT ATTCCAAAAG TGAANCCTAA AAAAGACGTG
GTTATTAAAG TNGGTGACAA ACAAAGTCAA AATGGNGCCA CAATCAAATT AGGGGAGAAN
TTCTTCTATG AATTTACAAG TAGTGACATT CCTGCAGAAT ACGCTGGNGT TGTGGAAGAA
TGGTCGATTA GCGATAAACT AGACGTCAAA CATGACAAAT TTAGTGGCCA ATGGTCTGTG
TTTGCCAATT CTAATTTTGT TTTAGCAGAC GGAACCAAAG TGAATAAAGG GGACGACATT
TCGAACTAT TCACGATGAC CTTTGAACAA GGGGTAGTGA AAATCACGGC CAGTCAAGCC
TTTTTNGATG CGATGAATCT AAAAGAAAAC AAAAACGTTG CACACTCATG GAAAGCGTTC
ATTGGTGTAG AACGAATTGC GGCAGGAGAC GTTTACAACA CAATCGAAGA ATCTTTCAAC
AATGAGAAGA TTAAAACNAA TACGGTAGTG ACNCATACGC CAGAAAAACC ACAAACNCCA
CCAGAAAAAA CAGTGATTGT ACCACCAACA CCAAAAACAC CGCAAGCACC AGTAGAGCCA
TTAGTGGTAG AAAAGGCAAG TGTNGTGCCA GAATTGCCGC AAACAGGCGA AAAACAAAAT
GTCTTATTAA CGGTAGCTGG TAGTTTAGCC GCAATGCTTG GCTTAGCAGG CTTAGGCTTT
AAACGTAGAA AAGAAACAAA ATAA

EF064-2 (SEQ ID NO:242)
MKAKK QYKTYKAKNH WVTVPILFLS VLGAVGLATD NVQAAELDTQ PETTTVQPNN
PDLQSEKETP KTAVSEEATV QKDTTSQPTK VEEVAPENKG TEQSSATPND TTNAQQPTVG
AEKSAQEQPV VSPETTNEPL GQPTEVAPAE NEVNKSTSIP KEFETPDVDK AVDEVKKDPN
ITVVEKPAED LGNVSSKDLA AKEKEVDQLQ KEQAKKIAQQ AAELKAKNEK IAKENAEIAA
KNKAEKERXX KEVAEYNKHK NENSYVNEAI SKNLVFDQSV VTKDTKISSI KGGKFIKATD
FNKVNAGDSK DIFTKLRKDM GGKXTGNFQN SFVKEANLGS NGGYAVLLEK NKPVTVTYTG
LNASYLGRKI TKAEFVYELQ SSPSQSGTLN AVFSNDPIIT AFIGTNRVNG KDVKTRLTIK
FFDASGKEVL PDKDSPFAYA LSSLNSSLTN KGGHAEFVSD FGANNAFKYI NGSYVKKQAD
GKFYSPEDID YGTGPSGLKN SDWDAVGHKN AYFGSGVGLA NGRISFSFGM TTKGKSNVPV
SSAQWFAFXT NLNAQSVKPI FNYGNPKEPE KATIEFNXYK ANVVPVLVPN KEVTDGQKNX
NDLNVXRGDS LQYIVTGDTT ELAKVDPKTV TKQGIRDTFD AEKVTIDLSK VKVYQADASL
NXKDXKAVAA ATNSGXAKDV TASYXLNLDQ NTVTAMMKTN ADGSVVLAMG YKYLLVLPFV
VKNVEGDFEN TAVQLTXDGE TVTNTVINHV PGSNPSKDVK ADKNGTVGSV SLHDKDIPLQ
TKTYYEVKSS ERPANYGGXT EEWGMNDVLD TTHDRFTGKW HAITXYDLKV GXKTLKAGTD
ISAYILLENK DNKDLTFTMN QALLAALNEG SNKVGKQAWS VYLEVERXKT GDVENTQTEN
YNKELVRSNT VVTHTPDDPK PTKAVHNKKG EXIXHGKVAR GDVLSYEMTW DLKGYDKFVA
FDTVDLATGV SFFDDYDETX VTPIKDLLRV KDSKGXDITN QFTISWDDAK GTVTXSAKDP
QAFILAXGGQ ELRVTLPTKV KADVSGDVYN SAEQNTFGQR IKTNTVVNHI PKVXPKKDVV
IKVGDKQSQN GATIKLGEXF FYEFTSSDIP AEYAGVVEEW SISDKLDVKH DKFSGQWSVF
ANSNFVLADG TKVNKGDDIS KLFTMTFEQG VVKITASQAF XDAMNLKENK NVAHSWKAFI
GVERIAAGDV YNTIEESFNN EKIKTNTVVT HTPEKPQTPP EKTVIVPPTP KTPQAPVEPL
VVEKASVVPE LPQTGEKQNV LLTVAGSLAA MLGLAGLGFK RRKETK

EF064-3 (SEQ ID NO:243)
AGTGACGAT TGATTTATCC AAAGTGAAAG TTTATCAAGC AGACGCAAGT
CTNAACGANA AAGACTNAAA AGCTGTTGCT GCAGCNATTA ATTCAGGAAN AGCTAAAGAC
GTGACTGCTT CTTATGANCT CAATTTAGAT CAAAACACCG TCACAGCAAT GATGAAAACC
AACGCNGACG GNTCGTTGT TTTAGCAATG GGGTATAAAT ATTTACTTGT CTTGCCGTTT
GTAGTGAAAA ATGTAGAAGG CGATTTTGAA AATACAGCTG TTCAGCTGAC AAANGATGGN
GAAACGGTAA CAAATACAGT GATTAACCAT GTGCCAGGTA GTAATCCTTC CAAAGATGTA
AAAGCAGATA AAAACGGTAC AGTTGGCAGT GTTTCTCTAC ATGATAAAGA TATTCCGTTA
CAAACAAAAA TTTATTATGA AGTGAAATCT TCCGAACGTC CAGCNAACTA TGGCGGAATN
ACNGAAGAAT GGGGCATGAA TGATGTCTTG GACACGACCC ATGATCGTTT CACAGGNAAA
TGGCACGCTA TTACNAANTA TGACCTTAAA GTAGGGGANA AAACGTTAAA AGCAGGAACA
GATATTTCTG CCTACATTCT TTTAGAAAAC AAAGACAATA AAGACTTGAC GTTTACNATG
AATCAAGCAT TATTGGCNGC NTTAAATGAA GGAAGCAATA AAGTAGGCAA ACAAGCTTGG
TCTGTGTATC TGGAAGTCGA ACGGATNAAA ACAGGTGACG TAGAAAACAC GCAAACAGAA
AACTACAACA AAGAGCTTGT NCGTTCTAAT ACNGTGGTGA CGCATACNCC TGATGATCCA
```

TABLE 1-continued

Nucleotide and Amino Acid Seqeuences of E. faecalis Genes.

```
AAACCAACCA AAGCCGTTCA TAACAAGAAA GGGGAAGANA TTAANCATGG AAAAGTNGCT
CGTGGTGATG TTCTTTCTTA TGAAATGACN TGGGACTTAA AAGGGTACGA TAAAGACTTT
GCCTTTGATA CAGTCGATCT TGCGACAGGC GTTTCTTTCT TCGATGATTA CGATGAAACG
AANGTGACAC CAATCAAAGA CTTACTTCGT GTCAAAGATT CTAAAGGGGN AGACATTACG
AACCAGTTCA CGATCTCNTG GGACGATGCC AAAGGCACGG TGACNATNTC TGCCAAAGAC
CCACAAGCCT TTATTCTAGC GNATGGTGGG CAAGAATTGC GTGTAACNCT CCCTACAAAA
GTCAAAGCCG ATGTTTCTGG NGATGTTTAT AATTCAGCGG AACAAAATAC ATTTGGNCAA
CGAATTAAAA CCAATACNGT TGTCAACCAT ATTCCAAAAG TGAANCCTAA AAAAGACGTG
GTTATTAAAG TNGGTGACAA ACAAAGTCAA AATGNGCCA CAATCAAATT AGGGGAGAAN
TTCTTCTATG AATTTACAAG TAGTGACATT CCTGCAGAAT ACGCTGGNGT TGTGGAAGAA
TGGTCGATTA GCGATAAACT AGACGTCAAA CATGACAAAT TTAGTGGCCA ATGGTCTGTG
TTTGCCAATT CTAATTTTGT TTTAGCAGAC GGAACCAAAG TGAATAAAGG GGACGACATT
TCGAAACTAT TCACGATGAC CTTTGAACAA GGGGTAGTGA AAATCACGGC CAGTCAAGCC
TTTTTNGATG CGATGAATCT AAAAGAAAAC AAAAACGTTG CACACTCATG GAAAGCGTTC
ATTGGTGTAG AACGAATTGC GGCAGGAGAC GTTTACAACA CAATCGAAGA ATCTTTCAAC
AATGAGAAGA TTAAAACNAA TACGGTAGTG ACNCATACGC CAGAAAAACC ACAAACNCCA
CCAGAAAAAA CAGTGATTGT ACCACCAACA CCAAAAACAC CGCAAGCACC AGTAGAGCCA
TTAGTGGTAG AAAAGGCAAG TGTNGTGCCA GAATTGCCGC AAACAGGCGA AAAACAAAT
GTCTTATTAA CGGTAGCTGG TAGTTTAGCC GCAATGCTTG GCTTAGCAGG CTTAGGCTTT
AAACGTAGAA AAGAAACAAA ATAA

EF064-4 (SEQ ID NO:244)
VTIDLSK VKVYQADASL
NXKDXKAVAA AINSGXAKDV TASYXLNLDQ NTVTAMMKTN ADGSVVLAMG YKYLLVLPFV
VKNVEGDFEN TAVQLTXDGE TVTNTVINHV PGSNPSKDVK ADKNGTVGSV SLHDKDIPLQ
TKIYYEVKSS ERPANYGGXT EEWGMNDVLD TTHDRFTGKW HAITXYDLKV GXKTLKAGTD
ISAYILLENK DNKDLTFTMN QALLAALNEG SNKVGKQAWS VYLEVERXKT GDVENTQTEN
YNKELVRSNT VVTHTPDDPK PTKAVHNKKG EXIXHGKVAR GDVLSYEMTW DLKGYDKDFA
FDTVDLATGV SFFDDYDETX VTPIKDLLRV KDSKGXDITN QFTISWDDAK GTVTXSAKDP
QAFILAXGGQ ELRVTLPTKV KADVSGDVYN SAEQNTFGQR IKTNTVVNHI PKVXPKKDVV
IKVGDKQSQN GATIKLGEXF FYEFTSSDIP AEYAGVVEEW SISDKLDVKH DKFSGQWSVF
ANSNFVLADG TKVNKGDDIS KLFTMTFEQG VVKITASQAF XDAMNLKENK NVAHSWKAFI
GVERIAAGDV YNTIEESFNN EKIKTNTVVT HTPEKPQTPP EKTVIVPPTP KTPQAPVEPL
WEKASV

EF065-1 (SEQ ID NO:245)
TAGCGAAAGA AAATAGGGAG GATTAAAATG TTTAAGAAAG CAACGAAATT ATTATCGACA
ATGGTGATTG TCGCTGGAAC AGTTGTGGGA AATTTCAGTC CCACATTGGC TTTAGCTGAA
GAAGCGGTTA AAGCAGGAGA TACGAAGGA ATGACCAATA CGGTGAAAGT GAAAGACGAC
AGTCTGGCTG ATTGTAAACG GATATTGGAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAA GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC CAAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATCACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAACAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCACCTGC ACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
```

TABLE 1-continued

Nucleotide and Amino Acid Seqeuences of E. faecalis Genes.

```
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCATTTACC AATGACTAAT
ACAACAGTAA ATCCACTTTA CATGATCGCA GGTTTAATTG TCCTTATAGT GGCTATTAGC
TTTGGCATAA CAAAAAATAA AAAAAGAAAA AATTAG

EF065-2 (SEQ ID NO:246)
MF KKATKLLSTM VIVAGTVVGN FSPTLALAEE AVKAGDTEGM TNTVKVKDDS
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF065-3 (SEQ ID NO:247)
GGTTA AAGCAGGAGA TACAGAAGGA ATGACCAATA CGGTGAAAGT GAAAGACGAC
AGTCTGGCTG ATTGTAAACG GATATTGAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC CAAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAGTAAC TTTTGAAATG AACAANCAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCACCTGC ACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACACAGCT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TT

EF065-4 (SEQ ID NO:248)
AVKAGDTEGM TNTVKVKDDS
```

TABLE 1-continued

Nucleotide and Amino Acid Seqeuences of E. faecalis Genes.

```
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDTENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWWVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIH

EF066-1 (SEQ ID NO:249)
TAGCGAAAGA AAATAGGGAG GATTAAAATG TTTAAGAAAG CAACGAAATT ATTATCGACA
ATGGTGATTG TCGCTGGAAC AGTTGTGGGA AATTTCAGTC CCACATTGGC TTTAGCTGAA
GAAGCGGTTA AGCAGGAGA TACAGAAGGA ATGACCAATA CGGTGAAAGT GAAAGACGAC
AGTCTGGCTG ATTGTAAACG GATATTGGAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC AAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTTG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAANCAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGCC ATTCCCAACC AAGCCGACTT GAACTTTGGC
AACGAAGGTG ACGTGTTGCA TTCCAACAAA CCAACCGTAA CACCACCTGC ACCAACGCCA
GAAGATCCAA CGATTACAAA AGATATCGAA GGCCAAGAAC ATTTAGATTT AACCAACCGT
GACCAAGAAT TTAAATGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCATTTACC AATGACTAAT
ACAACAGTAA ATCCACTTTA CATGATCGCA GGTTTAATTG TCCTTATAGT GGCTATTAGC
TTTGGCATAA CAAAAAATAA AAAAAGAAAA AATTAG

EF066-2 (SEQ ID NO:250)
MF KKATKLLSTM VIVAGTWGN FSPTLALAEE AVKAGDTEGM TNTVKVKDDS
LADCKRILEG QATFPVQAGE TEPVDLVWE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
```

TABLE 1-continued

Nucleotide and Amino Acid Seqeuences of *E. faecalis* Genes.

```
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF066-3 (SEQ ID NO:251)
GGTTA AAGCAGGAGA TACAGAAGGA ATGACCAATA CGGTGAAAGT GAAAGACGAC
AGTCTGGCTG ATTGTAAACG GATATTGAAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC AAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCA

EF066-4 (SEQ ID NO:252)
AVKAGDTEGM TNTVKVKDDS
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQTNGQ TISATSTEGY VGNTTIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVT

EF067-1 (SEQ ID NO:253)
TAGCGAAAGA AAATAGGGAG GATTAAAATG TTTAAGAAAG CAACGAAATT ATTATCGACA
ATGGTGATTG TCGCTGGAAC AGTTGTGGGA AATTTCAGTC CCACATTGGC TTTAGCTGAA
GAAGCGGTTA AAGCAGGAGA TACAGAAGGA ATGACCAATA CGGTGAAAGT GAAAGACGAC
AGTCTGGCTG ATTGTAAACG GATATTGAAA GGACAAGCTA CTTTCCCAGT TCAAGCGGGT
GAAACGGAAC CAGTCGATTT AGTAGTTGTT GAAGATGCTA GTGGTAGTTT TTCAdATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC AAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AATGGTAAA
GATGTTACAG CTAACGGCAC AGTAACACAA GAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTACACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAACAGC TTTCGGTAAC
```

TABLE 1-continued

Nucleotide and Amino Acid Seqeuences of E. faecalis Genes.

```
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAANCAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCCACCTG CACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCATTTACC AATGACTAAT
ACAACAGTAA ATCCACTTTA CATGATCGCA GGTTTAATTG TCCTTATAGT GGCTATTAGC
TTTGGCATAA CAAAAAATAA AAAAAGAAAA AATTAG

EF067-2 (SEQ ID NO:254)
MF KKATKLLSTM VIVAGTVVGN FSPTLALAEE AVKAGDTEGM TNTVKVKDDS
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDiNKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF067-3 (SEQ ID NO:255)
GCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC AACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAANCAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCCACCTG CACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TT

EF067-4 (SEQ ID NO:256)
VLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDJEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TTTTKIKTDA TDEELAPYIE QGGIPNQADL NFGNEGDVLH SNKPTVTPPA PTPEDPKKPE
PKQPLKPKKP LTPTNHQAPT NPVNFGKSAS KGIH

EF068-1 (SEQ ID NO:257)
TAGGGGAAGC TAATGATCTT GGTATTTATC GTTATTTTA AAGAAAAGAG GGACGATCAG
ATGAAAAGA AAATTGTTGA GGATTTTAAT CGGAAAAGTC AGCATAAAAA ATGGACAAAA
CGCAAGATGC TTAATTTAGC AATATCAAGT GGTTTATTAT TTACGTCATT AGCAATCCCT
```

TABLE 1-continued

Nucleotide and Amino Acid Seqeuences of E. faecalis Genes.

```
GTAAGTATAG CTGTTACCTC TGGCACAATC AGTGCATCAG CAGCGGTCTT GGATATCGAA
CTATTATCAA ATGTTACGTC AAATAATGAC AGTGGCACTT CAACGAGTAA TCGTTGGACA
GCCGCAAACC AAAATCAACC AGTTAATTTC ACGGTTTCTG GTGGCGCTTT AGCAGATGCT
TCCGCTGTGT TTAGTGGACA AAAACAAGCG GTGTTAGTGG TTCCTCCTGA GTTAAGAGGA
AATGTAGCTG CAGCAGGCAG CGCAGCAATC AATACCAATG TCACGATTGA TCTTTCAAAA
GTTACTTTTT TGACTGCCGT TTTGAATGCA GCCAATGATT TAACCAATGT GATTACTCAA
ATTACCAGTG GGGCGTTAGG GAATTTAACT GGTGTTGATA TTGATTTGAC GGAAGTGAAT
CGTCAATTGG AATTAGTTAA TAACATTGAA AACTTAGGTG CTGCTTCATT TACAGCTCCG
GAAACGTTAG CAGCTGACGG CTCATACATT AGTGCACCGA TTAGTGATGG TTTAGGGTTA
GTTTTAGCCC AAAATGTTTC AAACATCTTA CAAGATTTGA ATGCGGCAGT TCAAGCTTTG
GAGGCAAAAG GTACCAGTAT CCCAAGTAAT CTTGTCGCCG CAGCTATAAA TGCAGCCTTG
CTTCCTGTCA AAGGCACGGT AAACGTGGCT GTTTCAGGTG CTTTGCCTTT ATTAGCGGTT
GGTGGTTCAG GCGTAAATGA GTTAGTGGAT GCTTCTTTAC TAGGCACAAC CACGGTTACT
TTACCAACTA CCGTTTCAAC ACCTCAAAAT TTATCCAATA ATTTAGATGC TCGTTTTGTA
GGAACAGTCG TTCAAACAGA TCTTTTAGAC GTTAATTTAT TAGCAACAGC AGACGGTGTA
TCCAACATTT ATTTTGCTGC AGGCACTACT AGTGAAGTAA CCGCACCAAC AATCACAGGA
GTAACAGGTA ATTCAACAGC AGGTTACGAA GTTAAAGGAA CTGCCGATGC CAATGCCACG
GTTGAAATCC GAAATGCAGG AGGCACCGTA ATAGGCACAG GTACCGCTGA TGGGACAGGA
GCGTTTACAG TTACCGTTCC CGCAGGTGAA GCAGGCGCCA ATGAAACGTT AACCGCCGTA
GCGAAAAACG CCAGCGGNAC AGAAAGNACG CCAACAACGT TCCAAACNCC AGCGGATGAA
GCAACCGTAA CCGCACCAAC AATCACAGGA GTGACAGGTA ATTCAACGGC AGGTTACGAA
GTTAAAGGAA CTGCCGATGC CAATGCCACG GTTGAAATCC GAAATGCAGG AGGCACCGTA
ATAGGCACAG GTACCGCTGA TGGGACAGGA GCGTTTACAG TTACCGTTCC CGCAGGTGAA
GCAGGTGCCA ATGAAACGTT AACCGCCGTA GCGAAAAACG CCAGCGGCAC AGAAAGTACG
CCAACAACGT TCCAAACACC AGCGGATGAA GCAACCGTAA CCGCACCAAC AATCACAGGA
GTGACAGGTA ATTCAACAGC AGGTTACGAA GTTAAAGGAA CTGCCGATGC CAATGCCACG
GTTGAGATCC GAAATGCAGG AGGTGCCGTG ATAGGTACAG GTACTGCTGA TGGGACAGGG
GCATTTACAG TTACCATTCC CGCAGGTGAA GCAGGTGCGA ATGAAACGTT AACCGCCGTA
GCGAAAAACG CCAGCGGTAC AGAAAGTACG CCAACAACGT TCCAAACGCC AGCGGATCCT
AATACGCCCG TGGCGACGCC AATTGTTGAG ACTGTAACAG GTAGTACAAC AAAAGGCTAT
GAGGTCAAAG GGACTGCTGA AGTTGGCACC ACCATTGAGG TTCGCGATGC AGCTGGCACG
GTCCTTGGTA CTGCAACAAC TGGAACTGAC GGAAAATATA CAGTGACTTT AGATTCAGGA
ACAGCAACAG CAAATCAAAC GCTGAGCGTT GTAGCGAAAA ACGCTAGTGG CACGGAAAGT
CAACCAGCAA CGGCGACAAC ACCAGCTGAT GTCACTGCAC CAACAGTTGA TAACATCACA
GGCAACTCTG GTTCGGGTTA TGAAATTACA GGAACAGCAG ACCCTAACAC AACAATCGAA
GTTCGTGATC CATCTGGGGC AGTCATTGGT ACAGGTACCT CTGATGCGAA TGGTGATTTT
ACTGTAACGC TACCAACGGG AACGACCAAT CCTGGGGATA CGTTAACAGT GATTGGAAAG
GATAACGCGG GAAATGAAAG TCAACCGACT GAAGTCCTTG TTCCTGCTGA TGCCACGGTT
ACAGCACCAA CTGTAACAGG AGTAACAGGT AATTCAGTTG CTGGTTATCA GGTGACAGGC
ACCGCTGATC CGAATGCTAC CATCGAAATT CGTGATGCAG ATGGGAACGT GATTGCAACA
GGGACTGCCG ATGGGACTGG TTCCTTTGCT GTGAACCTTC CAGCTGGGAC GGCAAATGCG
AATGAAACAT TGACAGCGTT AGCCAAAGAT CCTGCTGGCA ATACAAGTAC ACCGACAACC
TTCCAAACAC CAGCAGATGA AGTAGTGGCA CCGCCAAGTG TCGACAAAGT TACTGGGAAT
ACAACACAAG GATATCAAGT GACAGGTACC GCTGAACTTG GCACCACCAT TGAAGTTCGT
GCAACAGACG GAACAGTTTT AGGCACCGCA ACAACTGGAC CGACTGGCCA ATATACTGTG
ACGTTAGCTT CAGGAAAAGC AACAGCTAAA CAAACAGTGA ATGTAGTTGC TAAAAATGAT
ACTGGACTTG AGAGTCAACC AACTACAGCT ATGACACCCG CTGATGTTAC CACACCAACA
ATTGGTGACA TTACTGGAGA TTCAACAACT GGTTATGAAA TCACTGGGAC GGCGGACCCT
AATACCACCA TTGAAGTACG GAACCCAGAT GGAACAATTA TTGGTACAAC GACAACGGAT
GATCAAGGAA ACTTTACTGT GGACCTTCCA GCGGGAGCCG CTAATCCTGG TGATACATTA
ACAGTTGTTG GAAAAGACGG TGACGGCAAT GAAAGTCAAC CAACGGAAGT GACGGTCCTT
GAAGATGCAA CCGTAGCAGC ACCAACTGTG ACGACTGTTA CAGGAACAAC TGCCACTGGG
TATCAAGTAA CCGGCACGGC AGAGCCAAAT GTCACCATTG AGATTCACAA TGAAGCAGGT
TTAGTTATTG CTACGGGAAC GACTGATGGT GCTGGCGCAT TTACAATCAC TCTTCCGACG
GGCACAGCAA CAGCTAACGA AGCCTTAACT GCCATTGCGA AAGATGCTGC TGGGAAAGAA
AGTAATCCGA CTGCTTTCAA AACACCTGCT GATCCAGATG CACCAGTCGC GACACCTACT
GTTGACAAAA TCACTGGTAG CACGACAAAC GGCTATCAAG TAGTAGGAGC AGCAGAAGTT
GGTACAACAG TTGAGGTGCG TGACGCCGAT GGCACAGTCC TTGGCATGGC AACTACTGGA
ACTGATGGCA AATACACAGT GACTTTAGAG CCAGGGAAGG CCTCAGCTAA CGAAACAATA
ACTGTCGTAG CGAAAAATGC AACAGGAAAA GAAAGTCAGC CAGCTACAGC AACTACACCA
GTCGACTTAG CCACACCAAC CATTGATTCT ATTACCGGAA ATTCTAGTAA AGGTTACGAA
ATCACTGAAA CGGCGGAGCC AAAAACCACT ATTGATGTCC GTGACGCAGA CGGAACCATC
ATTGCTGCTA CAACTGCTAA CGAAACCGGC CAATATACGG TGACTCTACC AGCTGGCACA
GTGACACCGG GAGAAACGAT TACGATTATT AGCAAAGATG GCGCAGGTAA TGAAAGTCAA
CCAGCTACAG CCGTTATTCC AGCGGATGTT GTTTTAGCGG CGCCAACTAT TACGAAGGTT
GAAGGAAACA AAGCCAATGG CTATACAGTC ACTGGAACTG CTGATCCAAA TGTCACGGTT
CAATTTTACA ATAGCAGTGA ACAATTATTG GCAAGTGACA ATACAACTAC TGGAGGTACC
TTCTCCGTTC ATATTGCAGC AGGGTTAGCA ACAGAAAAAG AAACGTTAAC CGCACTAACC
ACAGATACAC AAGGAAATGT GAGTCCTAAA ACCACATTTA TGACGCCAGC CGATATTACG
GGAGAACCAG AGATTAAAAT TGCGGCACCA ACTGTTTCTT CAGTTTTAGG AACGTCTAAA
GCCGGCTACC TCATCAAAGG AACAGCTGAA CCAAACCGAA TCATTCAAAT TAGTAACCGA
CTATTAAGAA GTGTGATTGC TGTAGGTGCC ACCGATGCTG AAGGCAACTT CGCTATCCAA
TTAACAGCGG GACAAGCGAC TGCTCAACAA AGTTTACTTG CGACAGCTAC CGATGGCGCA
GGACATTACA GTACGGCTAC AACCTTCATG ACGCCAGCCG ACCAACGAA TCCTGGAGGA
GGCAATGGTA ACACTGGCGG AAATAACGGC AATACAGGCG GCAATACAGG AAACAATGGC
GCAACTGGCG GGAATAATGG GAATGGTTCA AACACAGGTT CAAATCCAAA TGGAGGTTCT
GGTTTAGGCA CAACAGGTTC TGGCTTAGGT TCACTAGGCA ATGGCCTCGG TACAAATGGT
```

TABLE 1-continued

Nucleotide and Amino Acid Seqeuences of *E. faecalis* Genes.

```
AGTGGCTACC ACCCTAAACT AAGTACCATC AGTTATGGCA CTGGAAATCA CGGGAAAACA
GGCTACTTAC CTAGCACAGG TGAAAAAGAG TCTTCAGCCG TGACAACAAG TTTGTTTGGC
GCCTTTGTCG CACTCCTTGC GAGCATGGGA ATCATCAAAC GCAAACGTAA AAACTAG

EF068-2 (SEQ ID NO:258)
M KKKIVEDFNR KSQHKKWTKR KMLNLAISSG LLFTSLAIPV
SIAVTSGTIS ASAAVLDIEL LSNVTSNNDS GTSTSNRWTA ANQNQPVNFT VSGGALADAS
AVFSGQKQAV LVVPPELRGN VAAAGSAAIN TNVTIDLSKV TFLTAVLNAA NDLTNVITQI
TSGALGNLTG VDIDLTEVNR QLELVNNIEN LGAASFTAPE TLAADGSYIS APISDGLGLV
LAQNVSNILQ DLNAAVQALE AKGTSIPSNL VAAAINAALL PVKGTVNVAV SGALPLLAVG
GSGVNELVDA SLLGTTTVTL PTTVSTPQNL SNNLDARFVG TVVQTDLLDV NLLATADGVS
NIYFAAGTTS EVTAPTITGV TGNSTAGYEV KGTADANATV EIRNAGGTVI GTGTADGTGA
FTVTVPAGEA GANETLTAVA KNASGTEXTP TTFQTPADEA TVTAPTITGV TGNSTAGYEV
KGTADANATV EIRNAGGTVI GTGTADGTGA FTVTVPAGEA GANETLTAVA KNASGTESTP
TTFQTPADEA TVTAPTITGV TGNSTAGYEV KGTADANATV EIRNAGGAVI GTGTADGTGA
FTVTIPAGEA GANETLTAVA KNASGTESTP TTFQTPADPN TPVATPIVET VTGSTTKGYE
VKGTAEVGTT IEVRDAAGTV LGTATTGTDG KYTVTLDSGT ATANQTLSVV AKNASGTESQ
PATATTPADV TAPTVDNITG NSGSGYEITG TADPNTTIEV RDPSGAVIGT GTSDANGDFT
VTLPTGTTNP GDTLTVIGKD NAGNESQPTE VLVPADATVT APTVTGVTGN SVAGYQVTGT
ADPNATIEIR DADGNVIATG TADGTGSFAV NLPAGTANAN ETLTALAKDP AGNTSTPTTF
QTPADEVVAP PSVDKVTGNT TQGYQVTGTA ELGTTIEVFA TDGTVLGTAT TGPTGQYVTV
LASGKATAKQ TVNVVAKNDT GLESQPTTAM TPADVTTPTI GDITGDSTTG YEITGTADPN
TTIEVRNPDG TIIGTTTTDD QGNFTVDLPA GAANPGDTLT VVGKDGDGNE SQPTEVTVPE
DATVAAPTVT TVTGTTATGY QVTGTAEPNV TIEIHNEAGL VIATGTTDGA GAFTITLPTG
TATANEALTA IAKDAAGKES NPTAFKTPAD PDAPVATPTV DKITGSTTNG YQVVGAAEVG
TTVEVRDADG TVLGMATTGT DGKYTVTLEP GKASANETIT VVAKNATGKE SQPATATTPV
DLATPTIDSI TGNSSKGYEI TGTAEPKTTI DVRDADGTII AATTANETGQ YTVTLPAGVV
TPGETITIIS KDGAGNESQP ATAVIPADVV LAAPTITKVE GNKANGYTVT GTADPNVTVQ
FYNSSEQLLA SGNTTTGGTF SVHTAAGLAT EKETLTALTT DTQGNVSPKT TFMTPADITG
EPEIKIAAPT VSSVLGTSKA GYLIKGTAEP NRIIQISNRL LRSVIAVGAT DAEGNFAIQL
TAGQATAQQS LLATATDGAG HYSTATTFMT PADPTNPGGG NGNTGGNNGN TGGNTGNNGA
TGGNNGNGSN TGSNPNGGSG LGTTGSGLGS LGNGLGTNGS GYHPKLSTIS YGTGNHGKTG
YLPSTGEKES SAVTTSLFGA FVALLASMGI IKRKRKN

EF068-3 (SEQ ID NO:259)
CTC TGGCACAATC AGTGCATCAG CAGCGGTCTT GGATATCGAA
CTATTATCAA ATGTTACGTC AAATAATGAC AGTGGCACTT CAACGAGTAA TCGTTGGACA
GCCGCAAACC AAAATCAACC AGTTAATTTC ACGGTTTCTG GTGGCGCTTT AGCAGATGCT
TCCGCTGTGT TTAGTGGACA AAAACAAGCG GTGTTAGTGG TTCCTCCTGA GTTAAGAGGA
AATGTAGCTG CAGCAGGCAG CGCAGCAATC AATACCAATG TCACGATTGA TCTTTCAAAA
GTTACTTTTT TGACTGCCGT TTTGAATGCA GCCAATGATT TAACCAATGT GATTACTCAA
ATTACCAGTG GGGCGTTAGG GAATTTAACT GGTGTTGATA TTGATTTGAC GGAAGTGAAT
CGTCAATTGG AATTAGTTAA TAACATTGAA AACTTAGGTG CTGCTTCATT TACAGCTCCG
GAAACGTTAG CAGCTGACGG CTCATACATT AGTGCACCGA TTAGTGATGG TTTAGGGTTA
GTTTTTAGCCC AAAATGTTTC AAACATCTTA CAAGATTTGA ATGCGGCAGT TCAAGCTTTG
GAGGCAAAAG GTACCAGTAT CCCAAGTAAT CTTGTCGCCG CAGCTATAAA TGCAGCCTTG
CTTCCTGTCA AGGCACGGT AAACGTGGCT GTTTCAGGTG CTTTGCCTTT ATTAGCGGTT
GGTGGTTCAG GCGTAAATGA GTTAGTGGAT GCTTCTTTAC TAGGCACAAC CACGGTTACT
TTACCAACTA CCGTTTCAAC ACCTCAAAAT TTATCCAATA ATTTAGATGC TCGTTTTGTA
GGAACAGTCG TTCAAACAGA TCTTTTAGAC GTTAATTTAT TAGCAACAGC AGACGGTGTA
TCCAACATTT ATTTTGCTGC AGGCACTACT AGTGAAGTAA CCGACCAAC AATCACAGGA
GTAACAGGTA ATTCAACAGC AGGTTACGAA GTTAAAGGAA CTGCCGATGC CAATGCCACG
GTTGAAATCC GAAATGCAGG AGGCACCGTA ATAGGCACAG GTACCGCTGA TGGGACAGGA
GCGTTTACAG TTACCGTTCC CGCAGGTGAA GCAGGCGCCA ATGAAACGTT AACCGCCGTA
GCGAAAAACG CCAGCGGNAC AGAAAGNACG CCAACAACGT TCCAACNCC AGCGGATGAA
GCAACCGTAA CCGCACCAAC AATCACAGGA GTGACAGGTA ATTCAACAGC AGGTTACGAA
GTTAAAGGAA CTGCCGATGC CAATGCCACG GTTGAAATCC GAAATGCAGG AGGCACCGTA
ATAGGCACAG GTACCGCTGA TGGGACAGGA GCGTTTACAG TTACCGTTCC CGCAGGTGAA
GCAGGTGCCA ATGAAACGTT AACCGCCGTA GCGAAAACG CCAGCGGCAC AGAAAGTACG
CCAACAACGT TCCAAACACC AGCGGATGAA GCAACCGTAA CCGCACCAAC AATCACAGGA
GTGACAGGTA ATTCAACAGC AGGTTACGAA GTTAAAGGAA CTGCCGATGC CAATGCCACG
GTTGAGATCC GAAATGCAGG AGGTGCCGTG ATAGGTACAG GTACTGCTGA TGGGACAGGG
GCATTTACAG TTACCATTCC CGCAGGTGAA GCAGGTGCGA ATGAAACGTT AACCGCCGTA
GCGAAAAACG CCAGCGGTAC AGAAAGTACG CCAACAACGT TCCAAACGCC

EF068-4 (SEQ ID NO:260)
TSGTIS ASAAVLDIEL LSNVTSNNDS GTSTSNRWTA ANQNQPVNFT VSGGALADAS
AVFSGQKQAV LVVPPELRGN VAAAGSAAIN TNVTIDLSKV TFLTAVLNAA NDLTNVITQI
TSGALGNLTG VDIDLTEVNR QLELVNNIEN LGAASFTAPE TLAADGSYIS APISDGLGLV
LAQNVSNILQ DLNAAVQALE AKGTSIPSNL VAAAINAALL PVKGTVNVAV SGALPLLAVG
GSGVNELVDA SLLGTTTVTL PTTVSTPQNL SNNLDARFVG TVVQTDLLDV NLLATADGVS
NIYFAAGTTS EVTAPTITGV TGNSTAGYEV KGTADANATV EIRNAGGTVI GTGTADGTGA
FTVTVPAGEA GANETLTAVA KNASGTEXTP TTFQTP

EF069-1 (SEQ ID NO:261)
TAGGGGAAGC TAATGATCTT GGTATTTATC GTTTATTTTA AAGAAAAGAG GGACGATCAG
ATGAAAAAGA AAATTGTTGA GGATTTTAAT CGGAAAAGTC AGCATAAAAA ATGGACAAAA
```

TABLE 1-continued

Nucleotide and Amino Acid Seqeuences of E. faecalis Genes.

```
CGCAAGATGC TTAATTTAGC AATATCAAGT GGTTTATTAT TTACGTCATT AGCAATCCCT
GTAAGTATAG CTGTTACCTC TGGCACAATC AGTGCATCAG CAGCGGTCTT GGATATCGAA
CTATTATCAA ATGTTACGTC AAATAATGAC AGTGGCACTT CAACGAGTAA TCGTTGGACA
GCCGCAAACC AAAATCAACC AGTTAATTTC ACGGTTTCTG GTGGCGCTTT AGCAGATGCT
TCCGCTGTGT TTAGTGGACA AAAACAAGCG GTGTTAGTGG TTCCTCCTGA GTTAAGAGGA
AATGTAGCTG CAGCAGGCAG CGCAGCAATC AATACCAATG TCACGATTGA TCTTTCAAAA
GTTACTTTTT TGACTGCCGT TTTGAATGCA GCCAATGATT TAACCAATGT GATTACTCAA
ATTACCAGTG GGGCGTTAGG GAATTTAACT GGTGTTGATA TTGATTTGAC GGAAGTGAAT
CGTCAATTGG AATTAGTTAA TAACATTGAA AACTTAGGTG CTGCTTCATT TACAGCTCCG
GAAACGTTAG CAGCTGACGG CTCATACATT AGTGCACCGA TTAGTGATGG TTTAGGGTTA
GTTTTAGCCC AAAATGTTTC AAACATCTTA CAAGATTTGA ATGCGGCAGT TCAAGCTTTG
GAGGCAAAAG GTACCAGTAT CCCAAGTAAT CTTGTCGCCG CAGCTATAAA TGCAGCCTTG
CTTCCTGTCA AAGGCACGGT AAACGTGGCT GTTTCAGGTG CTTTGCCTTT ATTAGCGGTT
GGTGGTTCAG GCGTAAATGA GTTAGTGGAT GCTTCTTTAC TAGGCACAAC CACGGTTACT
TTACCAACTA CCGTTTCAAC ACCTCAAAAT TTATCCAATA ATTTAGATGC TCGTTTTGTA
GGAACAGTCG TTCAAACAGA TCTTTTAGAC GTTAATTTAT TAGCAACAGC AGACGGTGTA
TCCAACATTT ATTTTGCTGC AGGCACTACT AGTGAAGTAA CCGCACCAAC AATCACAGGA
GTAACAGGTA ATTCAACAGC AGGTTACGAA GTTAAAGGAA CTGCCGATGC CAATGCCACG
GTTGAAATCC GAAATGCAGG AGGCACCGTA ATAGGCACAG GTACCGCTGA TGGGACAGGA
GCGTTTACAG TTACCGTTCC CGCAGGTGAA GCAGGCGCCA ATGAAACGTT AACCGCCGTA
GCGAAAAACG CCAGCGGNAC AGAAAGNACG CCAACAACGT TCCAAACNCC AGCGGATGAA
GCAACCGTAA CCGCACCAAC AATCACAGGA GTGACAGGTA ATTCAACGGT AGGTTACGAA
GTTAAAGGAA CTGCCGATGC CAATGCCACG GTTGAAATCC GAAATGCAGG AGGCACCGTA
ATAGGCACAG GTACCGCTGA TGGGACAGGA GCGTTTACAG TTACCGTTCC CGCAGGTGAA
GCAGGTGCCA ATGAAACGTT AACCGCCGTA GCGAAAAACG CCAGCGGCAC AGAAAGTACG
CCAACAACGT TCCAAACACC AGCGGATGAA GCAACCGTAA CCGCACCAAC AATCACAGGA
GTGACAGGTA ATTCAACAGC AGGTTACGAA GTTAAAGGAA CTGCCGATGC CAATGCCACG
GTTGAGATCC GAAATGCAGG AGGTGCCGTG ATAGGTACAG GTACTGCTGA TGGGACAGGG
GCATTTACAG TTACCATTCC CGCAGGTGAA GCAGGTGCGA ATGAAACGTT AACCGCCGTA
GCGAAAAACG CCAGCGGTAC AGAAAGTACG CCAACAACGT TCCAAACGCC AGCGGATCCT
AATACGCCCG TGGCGACGCC AATTGTTGAG ACTGTAACAG GTAGTACAAC AAAAGGCTAT
GAGGTCAAAG GGACTGCTGA AGTTGGCACC ACCATTGAGG TTCGCGATGC AGCTGGCACG
GTCCTTGGTA CTGCAACAAC TGGAACTGAC GGAAAATATA CAGTGACTTT AGATTCAGGA
ACAGCAACAG CAAATCAAAC GCTGAGCGTT GTAGCGAAAA ACGCTAGTGG CACGGAAAGT
CAACCAGCAA CGGCGACAAC ACCAGCTGAT GTCACTGCAC AACAGTTGA TAACATCACA
GGCAACTCTG GTTCGGGTTA TGAAATTACA GGAACAGCAG ACCCTAACAC AACAATCGAA
GTTCGTGATC CATCTGGGGC AGTCATTGGT ACAGGTACCT CTGATGCGAA TGGTGATTTT
ACTGTAACGC TACCAACGGG AACGACCAAT CCTGGGGATA CGTTAACAGT GATTGGAAAG
GATAACGCGG GAAATGAAAG TCAACCGACT GAAGTCCTTG TTCCTGCTGA TGCCACGGTT
ACAGCACCAA CTGTAACAGG AGTAACAGGT AATTCAGTTG CTGGTTATCA GGTGACAGGC
ACCGCTGATC CGAATGCTAC CATCGAAATT CGTGATGCAG ATGGGAACGT GATTGCAACA
GGGACTGCCG ATGGGACTGG TTCCTTTGCT GTGAACCTTC CAGCTGGGAC GGCAAATGCG
AATGAAACAT TGACAGCGTT AGCCAAAGAT CCTGCTGGCA ATACAAGTAC ACCGACAACC
TTCCAAACAC CAGCAGATGA AGTAGTGGCA CCGCCAAGTG TCGACAAAGT TACTGGGAAT
ACAACACAAG GATATCAAGT GACAGGTACC GCTGAACTTG GCACCACCAT TGAAGTTCGT
GCAACAGACG GAACAGTTTT AGGCACCGCA ACAACTGGAC CGACTGGCCA ATATACTGTG
ACGTTAGCTT CAGGAAAAGC AACAGCTAAA CAAACAGTGA ATGTAGTTGC TAAAAATGAT
ACTGGACTTG AGAGTCAACC AACTACAGCT ATGACACCCG CTGATGTTAC CACACCAACA
ATTGGTGACA TTACTGGAGA TTCAACAACT GGTTATGAAA TCACTGGGAC GGCGGACCCT
AATACCACCA TTGAAGTACG GAACCCAGAT GGAACAATTA TTGGTACAAC GACAACGGAT
GATCAAGGAA ACTTTACTGT GGACCTTCCA GCGGGAGCCG CTAATCCTGG TGATACATTA
ACAGTTGTTG GAAAAGACGG TGACGGCAAT GAAAGTCAAC CAACGGAAGT GACGGTCCCT
GAAGATGCAA CCGTAGCAGC ACCAACTGTG ACGACTGTTA CAGGAACAAC TGCCACTGGG
TATCAAGTAA CCGGCACGGC AGAGCCAAAT GTCACCATTG AGATTCACAA TGAAGCAGGT
TTAGTTATTG CTACGGGAAC GACTGATGGT GCTGGCGCAT TTACAATCAC TCTTCCGACA
GGCACAGCAA CAGCTAACGA AGCCTTAACT GCCATTGCGA AAGATGCTGC TGGGAAAGAA
AGTAATCCGA CTGCTTTCAA AACACCTGCT GATCCAGATG CACCAGTCGC GACACCTACT
GTTGACAAAA TCACTGGTAG CACGACAAAC GGCTATCAAG TAGTAGGAGC AGCAGAAGTT
GGTACAACAG TTGAGGTGCG TGACGCCGAT GGCACAGTCC TTGGCATGGC AACTACTGGA
ACTGATGGCA AATACACAGT GACTTTAGAG CCAGGGAAGG CCTCAGCTAA CGAAACAATA
ACTGTCGTAG CGAAAAATGC AACAGGAAAA GAAAGTCAGC CAGCTACAGC AACTACACCA
GTCGACTTAG CCACACCAAC CATTGATTCT ATTACCGGAA ATTCTAGTAA AGGTTACGAA
ATCACTGGAA CGGCGGAGCC AAAAACCACT ATTGATGTCC GTGACGCAGA CGGAACCATC
ATTGCTGCTA CAACTGCTAA CGAAACCGGC CAATATACGG TGACTCTACC AGCTGGCGTA
GTGACACCAG GAGAAACGAT TACGATTATT AGCAAAGATG GCGCAGGTAA TGAAAGTCAA
CCAGCTACAG CCGTTATTCC AGCGGATGTT GTTTTAGCGG CGCCAACTAT TACGAAGGTT
GAAGGAAACA AAGCCAATGG CTATACAGTC ACTGGAACTG CTGATCCAAA TGTCACGGTT
CAATTTTACA ATAGCAGTGA ACAATTATTG GCAAGTGGCA ATACAACTAC TGGAGGTACC
TTCTCCGTTC ATATTGCAGC AGGGTTAGCA ACAGAAAAAG AAACGTTAAC CGCACTAACC
ACAGATACAC AAGGAAATGT GAGTCCTAAA ACCACATTTA TGACGCCAGC CGATATTACG
GGAGAACCAG AGATTAAAAT TGCGGCACCA ACTGTTTCTT CAGTTTTAGG AACGTCTAAA
GCCGGCTACC TCATCAAAGG AACAGCTGAA CCAAACCGAA TCATTCAAAT TAGTAACCGA
CTATTAAGAA GTGTGATTGC TGTAGGTGCC ACCGATGCTG AAGGCAACTT CGCTATCCAA
TTAACAGCGG GACAAGCGAC TGCTCAACAA AGTTTACTTG CGACAGCTAC CGATGGCGCA
GGACATTACA GTACGGCTAC AACCTTCATG ACGCCAGCCG ACCCAACGAA TCCTGGAGGA
GGCAATGGTA ACACTGGCGG AAATAACGGC AATACAGGCG GCAATACAGG AAACAATGGC
GCAACTGGCG GGAATAATGG GAATGGTTCA AACACAGGTT CAAATCCAAA TGGAGGTTCT
```

TABLE 1-continued

Nucleotide and Amino Acid Seqeuences of *E. faecalis* Genes.

```
GGTTTAGGCA CAACAGGTTC TGGCTTAGGT TCACTAGGCA ATGGCCTCGG TACAAATGGT
AGTGGCTACC ACCCTAAACT AAGTACCATC AGTTATGGCA CTGGAAATCA CGGGAAAACA
GGCTACTTAC CTAGCACAGG TGAAAAAGAG TCTTCAGCCG TGACAACAAG TTTGTTTGGC
GCCTTTGTCG CACTCCTTGC GAGCATGGGA ATCATCAAAC GCAAACGTAA AAACTAG
```

EF069-2 (SEQ ID NO:262)
M KKKIVEDFNR KSQHKKWTKR KMLNLAISSG LLFTSLAIPV
SIAVTSGTIS ASAAVLDIEL LSNVTSNNDS GTSTSNRWTA ANQNQPVNFT VSGGALADAS
AVFSGQKQAV LVVPPELRGN VAAAGSAAIN TNVTIDLSKV TFLTAVLNAA NDLTNVITQI
TSGALGNLTG VDIDLTEVNR QLELVNNIEN LGAASFTAPE TLAADGSYIS APISDGLGLV
LAQNVSNILQ DLNAAVQALE AKGTSIPSNL VAAAINAALL PVKGTVNVAV SGALPLLAVG
GSGVNELVDA SLLGTTTVTL PTTVSTPQNL SNNLDARFVG TVVQTDLLDV NLLATADGVS
NIYFAAGTTS EVTAPTITGV TGNSTAGYEV KGTADANATV EIRNAGGTVI GTGTADGTGA
FTVTVPAGEA GANETLTAVA KNASGTEXTP TTFQTPADEA TVTAPTITGV TGNSTAGYEV
KGTADANATV EIRNAGGTVI GTGTADGTGA FTVTVPAGEA GANETLTAVA KNASGTESTP
TTFQTPADEA TVTAPTITGV TGNSTAGYEV KGTADANATV EIRNAGGAVI GTGTADGTGA
FTVTIPAGEA GANETLTAVA KNASGTESTP TTFQTPADPN TPVATPIVET VTGSTTKGYE
VKGTAEVGTT IEVRDAAGTV LGTATTGTDG KYTVTLDSGT ATANQTLSVV AKNASGTESQ
PATATTPADV TAPTVDNITG NSGSGYEITG TADPNTTIEV RDPSGAVIGT GTSDANGDFT
VTLPTGTTNP GDTLTVIGKD NAGNESQPTE VLVPADATVT APTVTGVTGN SVAGYQVTGT
ADPNATIEIR DADGNVIATG TADGTGSFAV NLPAGTANAN ETLTALAKDP AGNTSTPTTF
QTPADEVVAP PSVDKVTGNT TQGYQVTGTA ELGTTIEVRA TDGTVLGTAT TGPTGQYTVT
LASGKATAKQ TVNVVAKNDT GLESQPTTAM TPADVTTPTI GDITGDSTTG YEITGTADPN
TTIEVRNPDG TIIGTTTTDD QGNFTVDLPA GAANPGDTLT VVGKDGDGNE SQPTEVTVPE
DATVAAPTVT TVTGTTATGY QVTGTAEPNV TIEIHNEAGL VIATGTTDGA GAFTITLPTG
TATANEALTA IAKDAAGKES NPTAFKTPAD PDAPVATPTV DKITGSTTNG YQVVGAAEVG
TTVEVRDADG TVLGMATTGT DGKYTVTLEP GKASANETIT VVAKNATGKE SQPATATTPV
DLATPTIDSI TGNSSKGYEI TGTAEPKTTT DVRDADGTII AATTANETGQ YTVTLPAGVV
TPGETITIIS KDGAGNESQP ATAVIPADVV LAAPTITKVE GNKANGYTVT GTADPNVTVQ
FYNSSEQLLA SGNTTTGGTF SVHIAAGLAT EKETLTALTT DTQGNVSPKT TFMTPADITG
EPEIKIAAPT VSSVLGTSKA GYLIKGTAEP NRIIQISNRL LRSVIAVGAT DAEGNFAIQL
TAGQATAQQS LLATATDGAG HYSTATTFMT PADPTNPGGG NGNTGGNNGN TGGNTGNNGA
TGGNNGNGSN TGSNPNGGSG LGTTGSGLGS LGNGLGTNGS GYHPKLSTIS YGTGNHGKTG
YLPSTGEKES SAVTTSLFGA FVALLASMGI IKRKRKN

EF069-3 (SEQ ID NO:263)
AGGTGAA GCAGGTGCGA ATGAAACGTT AACCGCCGTA
GCGAAAAACG CCAGCGGTAC AGAAAGTACG CCAACACGT TCCAAACGCC AGCGGATCCT
AATACGCCCG TGGCGACGCC AATTGTTGAG ACTGTAACAG GTAGTACAAC AAAAGGCTAT
GAGGTCAAAG GGACTGCTGA AGTTGGCACC ACCATTGAGG TTCGCGATGC AGCTGGCACG
GTCCTTGGTA CTGCAACAAC TGGAACTGAC GGAAAATATA CAGTGACTTT AGATTCAGGA
ACAGCAACAG CAAATCAAAC GCTGAGCGTT GTAGCGAAAA ACGCTAGTGG CACGGAAAGT
CAACCAGCAA CGGCGACAAC ACCAGCTGAT GTCACTGCAC CAACAGTTGA TAACATCACA
GGCAACTCTG GTTCGGGTTA TGAAATTACA GGAACAGCAG ACCCTAACAC AACAATCGAA
GTTCGTGATC CATCTGGGGC AGTCATTGGT ACAGGTACCT CTGATGCGAA TGGTGATTTT
ACTGTAACGC TACCAACGGG AACGACCAAT CCTGGGGATA CGTTAACAGT GATTGGAAAG
GATAACGCGG GAAATGAAAG TCAACCGACT GAAGTCCTTG TTCCTGCTGA TGCCACGGTT
ACAGCACCAA CTGTAACAGG AGTAACAGGT AATTCAGTTG CTGGTTATCA GGTGACAGGC
ACCGCTGATC CGAATGCTAC CATCGAAATT CGTGATGCAG ATGGGAACGT GATTGCAACA
GGGACTGCCG ATGGGACTGG TTCCTTTGCT GTGAACCTTC CAGCTGGGAC GGCAAATGCG
AATGAAACAT TGACAGCGTT AGCCAAAGAT CCTGCTGGCA ATACAAGTAC ACCGACAACG
TTCCAAACAC CAGCAGATGA AGTAGTGGCA CCGCCAAGTG TCGACAAAGT TACTGGGAAT
ACAACACAAG GATATCAAGT GACAGGTACC GCTGAACTTG GCACCACCAT TGAAGTTCGT
GCAACAGACG GAACAGTTTT AGGCACCGCA ACAACTGGAC CGACTGGCCA ATATACTGTG
ACGTTAGCTT CAGGAAAAGC AACAGCTAAA CAAACAGTGA ATGTAGTTGC TAAAAATGAT
ACTGGACTTG AGAGTCAACC AACTACAGCT ATGACACCCG CTGATGTTAC CACACCAACA
ATTGGTGACA TTACTGGAGA TTCAACAACT GGTTATGAAA TCACTGGGAC GGCGGACCCT
AATACCACCA TTGAAGTACG GAACCCAGAT GGAACAATTA TTGGTACAAC GACAACGGAT
GATCAAGGAA ACTTTACTGT GGACCTTCCA GCGGGAGCCG CTAATCCTGG TGATACATTA
ACAGTTGTTG GAAAAGACGG TGACGGCAAT GAAAGTCAAC CAACGGAAGT GACGGTCCCT
GAAGATGCAA CCGTAGCAGC ACCAACTGTG ACGACTGTTA CAGGAA

EF069-4 (SEQ ID NO:264)
AGEA GANETLTAVA KNASGTEXTP TTFQTPADEA TVTAPTITGV TGNSTAGYEV
KGTADANATV EIRNAGGTVI GTGTADGTGA FTVTVPAGEA GANETLTAVA KNASGTESTP
TTFQTPADEA TVTAPTITGV TGNSTAGYEV KGTADANATV EIRNAGGAVI GTGTADGTGA
FTVTIPAGEA GANETLTAVA KNASGTESTP TTFQTPADPN TPVATPIVET VTGSTTKGYE
VKGTAEVGTT IEVRDAAGTV LGTATTGTDG KYTVTLDSGT ATANQTLSVV AKNASGTESQ
PATATTPADV TAPTVDNITG NSGSGYEITG TADPNTTIEV RDPSGAVIGT GTSDANGDFT
VTLPTGTTNP GDTLTVIGKD NAGNESQPTE VLVPADATVT APTVTGVTGN SVAGYQVTGT
ADPNATIEIR DADGNVIATG TADGTGSFAV NLPAGTANAN ETLTALAKDP AGNTSTPTTF
QTPADEVVAP PSVDKVTGNT TQGYQVTGTA ELGTTIEVRA TDGTVLGTAT TGPTGQYTVT
LASGKATAKQ TVNVVAKNDT GLESQPTTAM TPADVTTPTI GDITGDSTTG YEITGTADPN
TTIEVRNPDG TIIGTTTTDD QGNFTVDLPA GAANPGDTLT VVGKDGDGNE SQPTEVTVPE
DATVAAPTVT TVTGT

EF070-1 (SEQ ID NO:265)

TABLE 1-continued

Nucleotide and Amino Acid Seqeuences of E. faecalis Genes.

```
TAGGGGAAGC TAATGATCTT GGTATTTATC GTTTATTTTA AAGAAAAGAG GGACGATCAG
ATGAAAAAGA AAATTGTTGA GGATTTTAAT CGGAAAAGTC AGCATAAAAA ATGGACAAAA
CGCAAGATGC TTAATTTAGC AATATCAAGT GGTTTATTAT TTACGTCATT AGCAATCCCT
GTAAGTATAG CTGTTACCTC TGGCACAATC AGTGCATCAG CAGCGGTCTT GGATATCGAA
CTATTATCAA ATGTTACGTC AAATAATGAC AGTGGCACTT CAACGAGTAA TCGTTGGACA
GCCGCAAACC AAAATCAACC AGTTAATTTC ACGGTTTCTG GTGGCGCTTT AGCAGATGCT
TCCGCTGTGT TTAGTGGACA AAAACAAGCG GTGTTAGTGG TTCCTCCTGA GTTAAGAGGA
AATGTAGCTG CAGCAGGCAG CGCAGCAATC AATACCAATG TCACGATTGA TCTTTCAAAA
GTTACTTTTT TGACTGCCGT TTTGAATGCA GCCAATGATT TAACCAATGT GATTACTCAA
ATTACCAGTG GGGCGTTAGG GAATTTAACT GGTGTTGATA TTGATTTGAC GGAAGTGAAT
CGTCAATTGG AATTAGTTAA TAACATTGAA AACTTAGGTG CTGCTTCATT TACAGCTCCG
GAAACGTTAG CAGCTGACGG CTCATACATT AGTGCACCGA TTAGTGATGG TTTAGGGTTA
GTTTTAGCCC AAAATGTTTC AAACATCTTA CAAGATTTGA ATGCGGCAGT TCAAGCTTTG
GAGGCAAAAG GTACCAGTAT CCCAAGTAAT CTTGTCGCCG CAGCTATAAA TGCAGCCTTG
CTTCCTGTCA AAGGCACGGT AAACGTGGCT GTTTCAGGTG CTTTGCCTTT ATTAGCGGTT
GGTGGTTCAG GCGTAAATGA GTTAGTGGAT GCTTCTTTAC TAGGCACAAC CACGGTTACT
TTACCAACTA CCGTTTCAAC ACCTCAAAAT TTATCCAATA ATTTAGATGC TCGTTTTGTA
GGAACAGTCG TTCAAACAGA TCTTTTAGAC GTTAATTTAT TAGCAACAGC AGACGGTGTA
TCCAACATTT ATTTTGCTGC AGGCACTACT AGTGAAGTAA CCGCACCAAC AATCACAGGA
GTAACAGGTA ATTCAACAGC AGGTTACGAA GTTAAAGGAA CTGCCGATGC CAATGCCACG
GTTGAAATCC GAAATGCAGG AGGCACCGTA ATAGGCACAG GTACCGCTGA TGGGACAGGA
GCGTTTACAG TTACCGTTCC CGCAGGTGAA GCAGGCGCCA ATGAAACGTT AACCGCCGTA
GCGAAAAACG CCAGCGGNAC AGAAAGNACG CCAACAACGT TCCAAACNCC AGCGGATGAA
GCAACCGTAA CCGCACCAAC AATCACAGGA GTGACAGGTA ATTCAACGGC AGGTTACGAA
GTTAAAGGAA CTGCCGATGC CAATGCCACG GTTGAAATCC GAAATGCAGG AGGCACCGTA
ATAGGCACAG GTACCGCTGA TGGGACAGGA GCGTTTACAG TTACCGTTCC CGCAGGTGAA
GCAGGTGCCA ATGAAACGTT AACCGCCGTA GCGAAAAACG CCAGCGGCAC AGAAAGTACG
CCAACAACGT TCCAAACACC AGCGGATGAA GCAACCGTAA CCGCACCAAC AATCACAGGA
GTGACAGGTA ATTCAACAGC AGGTTACGAA GTTAAAGGAA CTGCCGATGC CAATGCCACG
GTTGAGATCC GAAATGCAGG AGGTGCCGTG ATAGGTACAG GTACTGCTGA TGGGACAGGG
GCATTTACAG TTACCATTCC CGCAGGTGAA GCAGGTGCCA ATGAAACGTT AACCGCCGTA
GCGAAAAACG CCAGCGGTAC AGAAAGTACG CCAACAACGT TCCAAACGCC AGCGGATCCT
AATACGCCCG TGGCGACGCC AATTGTTGAG ACTGTAACGA GTAGTACAAC AAAAGGCTAT
GAGGTCAAAG GGACTGCTGA AGTTGGCACC ACCATTGAGG TTCGCGATGC AGCTGGCACG
GTCCTTGGTA CTGCAACAAC TGGAACTGAC GGAAAATATA CAGTGACTTT AGATTCAGGA
ACAGCAACAG CAAATCAAAC GCTGAGCGTT GTAGCGAAAA ACGCTAGTGG CACGGAAAGT
CAACCAGCAA CGGCGACAAC ACCAGCTGAT GTCACTGCAC CAACAGTTGA TAACATCACA
GGCAACTCTG GTTCGGGTTA TGAAATTACA GGAACAGCAG ACCCTAACAC AACAATCGAA
GTTCGTGATC CATCTGGGGC AGTCATTGGT ACAGGTACCT CTGATGCGAA TGGTGATTTT
ACTGTAACGC TACCAACGGG AACGACCAAT CCTGGGGATA CGTTAACAGT GATTGGAAAG
GATAACGCGG GAAATGAAAG TCAACCGACT GAAGTCCTTG TTCCTGCTGA TGCCACGGTT
ACAGCACCAA CTGTAACAGG AGTAACAGGT AATTCAGTTG CTGGTTATCA GGTGACAGGC
ACCGCTGATC CGAATGCTAC CATCGAAATT CGTGATGCAG ATGGGAACGT GATTGCAACA
GGGACTGCCG ATGGGACTGG TTCCTTTGCT GTGAACCTTC CAGCTGGGAC GGCAAATGCG
AATGAAACAT TGACAGCGTT AGCCAAAGAT CCTGCTGGCA ATACAAGTAC ACCGACAACC
TTCCAAACAC CAGCAGATGA AGTAGTGGCA CCGCCAAGTG TCGACAAAGT TACTGGGAAT
ACAACACAAG GATATCAAGT GACAGGTACC GCTGAACTTG GCACCACCAT TGAAGTTCGT
GCAACAGACG GAACAGTTTT AGGCACCGCA ACAACTGGAC CGACTGGCCA ATATACTGTG
ACGTTAGCTT CAGGAAAAGC AACAGCTAAA CAAACAGTGA ATGTAGTTGC TAAAAATGAT
ACTGGACTTG AGAGTCAACC AACTACAGCT ATGACACCCG CTGATGTTAC CACACCAACA
ATTGGTGACA TTACTGGAGA TTCAACAACT GGTTATGAAA TCACTGGGAC GGCCGGACCCT
AATACCACCA TTGAAGTACG GAACCCAGAT GGAACAATTA TTGGTACAAC GACAACGGAT
GATCAAGGAA ACTTTACTGT GGACCTTCCA GCGGGAGCCG CTAATCCTGG TGATACATTA
ACAGTTGTTG GAAAAGACGG TGACGGCAAT GAAAGTCAAC CAACGGAAGT GACGGTCCCT
GAAGATGCAA CCGTAGCGAC ACCAACTGTG ACGACTGTTA CAGGAACAAC TGCCACTGGG
TATCAAGTAA CCGGCACGGC AGAGCCAAAT GTCACCATTG AGATTCACAA TGAAGCAGGT
TTAGTTATTG CTACGGGAAC GACTGATGGT GCTGGCGCAT TTACAATCAC TCTTCCGACG
GGCACAGCAA CAGCTAACGA AGCCTTAACT GCCATTGCGA AAGATGCTGC TGGGAAAGAA
AGTAATCCGA CTGCTTTCAA AACACCTGCT GATCCAGATG CACCAGTCGA CACCTACT
GTTGACAAAA TCACTGGTAG CACGACAAAC GGCTATCAAG TAGTAGGAGC AGCAGAAGTT
GGTACAACAG TTGAGGTGCG TGACGCCGAT GGCACAGTCC TTGGCATGGC AACTACTGGA
ACTGATGCA AATACACAGT GACTTTAGAG CCAGGGAAGG CCTCAGCTAA CGAAACAATA
ACTGTCGTAG CGAAAAATGC AACAGGAAAA GAAAGTCAGC CAGCTACAGC AACTACACCA
GTCGACTTAG CCACACCAAC CATTGATTCT ATTACCGGAA ATTCTAGTAA AGGTTACGAA
ATCACTGGAA CGGCGGAGCC AAAAACCACT ATTGATGTCC GTGACGCAGA CGGAACCATC
ATTGCTGCTA CAACTGCTAA CGAAACCGGC CAATATACGG TGACTCTACC AGCTGGCGTA
GTGACACCAG GAGAAACGAT TACGATTATT AGCAAAGATG GCGCAGGTAA TGAAAGTCAA
CCAGCTACAG CCGTTATTCC AGCGGATGTT GTTTTAGCGG CGCCAACTAT TACGAAGGTT
GAAGGAAACA AAGCCAATGG CTATACAGTC ACTGGAACTG CTGATCCAAA TGTCACGGTT
CAATTTTACA ATAGCAGTGA ACAATTATTG CAAGTGGCA ATACAACTAC TGGAGGTACC
TTCTCCGTTC ATATTGCAGC AGGGTTAGCA ACAGAAAAAG AAACGTTAAC CGCACTAACC
ACAGATACAC AAGGAAATGT GAGTCCTAAA ACCACATTTA TGACGCCAGC CGATATTACG
GGAGAACCAG AGATTAAAAT TGCGGCACCA ACTGTTTCTT CAGTTTTAGG AACGTCTAAA
GCCGGCTACC TCATCAAAGG AACAGCTGAA CCAAACCGAA TCATTCAAAT TAGTAACCGA
CTATTAAGAA GTGTGATTGC TGTAGGTGCC ACCGATGCTG AAGGCAACTT CGCTATCCAA
TTAACAGCGG GACAAGCGAC TGCTCAACAA AGTTTACTTG CGACAGCTAC CGATGGCGCA
GGACATTACA GTACGGCTAC AACCTTCATG ACGCCAGCCG ACCCAACGAA TCCTGGAGGA
```

TABLE 1-continued

Nucleotide and Amino Acid Sequences of E. faecalis Genes.

```
GGCAATGGTA ACACTGGCGG AAATAACGGC AATACAGGCG GCAATACAGG AAACAATGGC
GCAACTGGCG GGAATAATGG GAATGGTTCA AACACAGGTT CAAATCCAAA TGGAGGTTCT
GGTTTAGGCA CAACAGGTTC TGGCTTAGGT TCACTAGGCA ATGGCCTCGG TACAAATGGT
AGTGGCTACC ACCCTAAACT AAGTACCATC AGTTATGGCA CTGGAAATCA CGGGAAAACA
GGCTACTTAC CTAGCACAGG TGAAAAAGAG TCTTCAGCCG TGACAACAAG TTTGTTTGGC
GCCTTTGTCG CACTCCTTGC GAdCATGGGA ATCATCAAAC GCAAACGTAA AAACTAG

EF070-2 (SEQ ID NO:266)
M KKKIVEDFNR KSQHKKWTKR KMLNLAISSG LLFTSLAIPV
SIAVTSGTIS ASAAVLDIEL LSNVTSNNDS GTSTSNRWTA ANQNQPVNFT VSGGALADAS
AVFSGQKQAV LVVPPELRGN VAAAGSAAIN TNVTIDLSKV TFLTAVLNAA NDLTNVITQI
TSGALGNLTG VDIDLTEVNR QLELVNNIEN LGAASFTAPE TLAADGSYIS APISDGLGLV
LAQNVSNILQ DLNAAVQALE AKGTSIPSNL VAAAINAALL PVKGTVNVAV SGALPLLAVG
GSGVNELVDA SLLGTTTVTL PTTVSTPQNL SNNLDARFVG TVVQTDLLDV NLLATADGVS
NIYFAAGTTS EVTAPTITGV TGNSTAGYEV KGTADANATV EIRNAGGTVI GTGTADGTGA
FTVTVPAGEA GANETLTAVA KNASGTEXTP TTFQTPADEA TVTAPTITGV TGNSTAGYEV
KGTADANATV EIRNAGGTVI GTGTADGTGA FTVTVPAGEA GANETLTAVA KNASGTESTP
TTFQTPADEA TVTAPTITGV TGNSTAGYEV KGTADANATV EIRNAGGAVI GTGTADGTGA
FTVTIPAGEA GANETLTAVA KNASGTESTP TTFQTPADPN TPVATPIVET VTGSTTKGYE
VKGTAEVGTT IEVRDAAGTV LGTATTGTDG KYTVTLDSGT ATANQTLSVV AKNASGTESQ
PATATTPADV TAPTVDNITG NSGSGYEITG TADPNTTIEV RDPSGAVIGT GTSDANGDFT
VTLPTGTTNP GDTLTVIGKD NAGNESQPTE VLVPADATVT APTVGVTGN SVAGYQVTGT
ADPNATIEIR DADGNVIATG TADGTGSFAV NLPAGTANAN ETLTALAKDP AGNTSTPTTF
QTPADEVVAP PSVDKVTGNT TQGYQVTGTA ELGTTIEVRA TDGTVLGTAT TGPTGQYTVT
LASGKATAKQ TVNVVAKNDT GLESQPTTAM TPADVTTPTI GDITGDSTTG YEITGTADPN
TTIEVRNPDG TIIGTTTTDD QGNFTVDLPA GAANPGDTLT VVGKDGDGNE SQPTEVTVPE
DATVAAPTVT TVTGTTATGY QVTGTAEPNV TIEIHNEAGL VIATGTTDGA GAFTITLPTG
TATANEALTA IAKDAAGKES NPTAFKTPAD PDAPVATPTV DKITGSTTNG YQVVGAAEVG
TTVEVRDADG TVLGMATTGT DGKYTVTLEP GKASANETIT VVAKNATGKE SQPATATTPV
DLATPTIDSI TGNSSKGYEI TGTAEPKTTI DVRDADGTII AATTANETGQ YTVTLPAGVV
TPGETITIIS KDGAGNESQP ATAVIPADVV LAAPTITKVE GNKANGYTVT GTADPNVTVQ
FYNSSEQLLA SGNTTTGGTF SVHIAAGLAT EKETLTALTT DTQGNVSPKT TFMTPADITG
EPEIKIAAPT VSSVLGTSKA GYLIKGTAEP NRIIQISNRL LRSVIAVGAT DAEGNFAIQL
TAGQATAQQS LLATATDGAG HYSTATTFMT PADPTNPGGG NGNTGGNNGN TGGNTGNNGA
TGGNNGNGSN TGSNPNGGSG LGTTGSGLGS LGNGLGTNGS GYHPKLSTIS YGTGNHGKTG
YLPSTGEKES SAVTTSLFGA FVALLASMGI IKRKRKN

EF070-3 (SEQ ID NO:267)
CGG TGACGGCAAT GAAAGTCAAC CAACGGAAGT GACGGTCCCT
GAAGATGCAA CCGTAGCAGC ACCAACTGTG ACGACTGTTA CAGGAACAAC TGCCACTGGG
TATCAAGTAA CCGGCACGGC AGAGCCAAAT GTCACCATTG AGATTCACAA TGAAGCAGGT
TTAGTTATTG CTACGGGAAC GACTGATGGT GCTGGCGCAT TTACAATCAC TCTTCCGACG
GGCACAGCAA CAGCTAACGA AGCCTTAACT GCCATTGCAA AAGATGCTGC TGGGAAAGAA
AGTAATCCGA CTGCTTTCAA AACACCTGCT GATCCAGATG CACCAGTCGC GACACCTACT
GTTGACAAAA TCACTGGTAG CACGACAAAC GGCTATCAAG TAGTAGGAGC AGCAGAAGTT
GGTACAACAG TTGAGGTGCG TGACGCCGAT GGCACAGTCC TTGGCATGGC AACTACTGGA
ACTGATGGCA AATACACAGT GACTTTAGAG CCAGGGAAGG CCTCAGCTAA CGAAACAATA
ACTGTCGTAG CGAAAAATGC AACAGGAAAA GAAAGTCAGG CAGCTACAGC AACTACACCA
GTCGACTTAG CCACACCAAC CATTGATTCT ATTACCGGAA ATTCTAGTAA AGGTTACGAA
ATCACTGGAA CGGCGGAGCC AAAAACCACT ATTGATGTCC GTGACGCAGA CGGAACCATC
ATTGCTGCTA CAACTGCTAA CGAAACCGGC CAATATACGG TGACTCTACC AGCTGGCGTA
GTGACACCAG GAGAAACGAT TACGATTATT AGCAAAGATG GCGCAGGTAA TGAAAGTCAA
CCAGCTACAG CCGTTATTCC AGCGGATGTT GTTTTAGCGG CGCCAACTAT TACGAAGGTT
GAAGGAAACA AAGCCAATGG CTATACAGTC ACTGGAACTG CTGATCCAAA TGTCACGGTT
CAATTTTACA ATAGCAGTGA ACAATTATTG GCAAGTGGCA ATACAACTAC TGGAGGTACC
TTCTCCGTTC ATATTGCAGC AGGGTTAGCA ACAGAAAAAG AAACGTTAAC CGCACTAACC
ACAGATACAC AAGGAAATGT GAGTCCTAAA ACCACATTTA TGACGCCAGC CGATATTACG
GGAGAACCAG AGATTAAAAT TGCGGCACCA ACTGTTTCTT CAGTTTTAGG AACGTCTAAA
GCCGGCTACC TCATCAAAGG AACAGCTGAA CCAAACCGAA TCATTCAAAT TAGTAACCGA
CTATTAAGAA GTGTGATTGC TGTAGGTGCC ACCGATGCTG AAGGCAACTT CGCTATCCAA
TTAACAGCGG GACAAGCGAC TGCTCAACAA AGTTTACTTG CGACAGCTAC CGATGGCGCA
GGACATTACA GTACGGCTAC AACCTTCATG ACGCCAGCCG ACCCAACGAA TCCTGGAGGA
GGCAATGGTA ACACTGGCGG AAATAACGGC AATACAGGCG GCAATACAGG AAACAATGGC
GCAACTGGCG GGAATAATGG GAATGGTTCA AACACAGGTT CAAATCCAAA TGGAGGTTCT
GGTTTAGGCA CAACAGGTTC TGGCTTAGGT TCACTAGGCA ATGGCCTCGG TACAAATGGT
AGTGGCTACC ACCCTAAACT AAGTACCATC AGTTATGGCA CTGGAAATCA CGGGAAAACA
GGCTACT

EF70-4 (SEQ ID NO:268)
DGDGNE SQPTEVTVPE
DATVAAPTVT TVTGTTATGY QVTGTAEPNV TIEIHNEAGL VIATGTTDGA GAFTITLPTG
TATANEALTA IAKDAAGKES NPTAFKTPAD PDAPVATPTV DKITGSTTNG YQWGAAEVG
TTVEVRDADG TVLGMATTGT DGKYTVTLEP GKASANETIT VVAKNATGKE SQPATATTPV
DLATPTIDSI TGNSSKGYEI TGTAEPKTTI DVRDADGTII AATTANETGQ YTVTLPAGVV
TPGETITIIS KDGAGNESQP ATAVIPADVV LAAPTITKVE GNKANGYTVT GTADPNVTVQ
FYNSSEQLLA SGNTTTGGTF SVHIAAGLAT EKETLTALTT DTQGNVSPKT TFMTPADITG
EPEIKIAAPT VSSVLGTSKA GYLIKGTAEP NRIIQISNRL LRSVIAVGAT DAEGNFAIQL
```

TABLE 1-continued

Nucleotide and Amino Acid Seqeuences of E. faecalis Genes.

TAGQATAQQS LLATATDGAG HYSTATTFMT PADPTNPGGG NGNTGGNNGN TGGNTGNNGA
TGGNNGNGSN TGSNPNGGSG LGTTGSGLGS LGNGLGTNGS GYHPKLSTIS YGTGNHGKTG
YL

EF071-1 (SEQ ID NO:269)
TAAGTAGAAG TGGTCGGGAC AAACGTAGAA CTTTCGCTGA TTGCCGAAGA AATTACTTCT
GTCCCGCCAT TTATCTGCAG GTTTAAGCCG TGGAAGGGAA GTTATTTTGA CTTTCCTTTC
ATGGCTTTTT TAAGAAAGGA GCATGCTATG TTTAAAAAAT TAATGATTCA ACTTGCTTTA
GTGATTGGTT TAAGTTTAAC GATTCCGATG ACGGCTTNCG CTTACACCAT CGAAGCGGAT
CCAATCAACT TTACTTATTT TCCCGGCTCT GCAAGCAATG AATTAATTGT TTTACATGAA
TCTGGAAACG AGCGGAACCT AGGACCACAC AGTTTAGACA ATGAAGTGGC CTATATGAAA
CGAAATTGGT CAAATGCTTA TGTCTCATAT TTTGTCGGAT CTGGTGGACG AGTGAAACAA
TTAGCTCCTG CTGGCCAAAT TCAATATGGC GCAGGTTCTT TAGCTAATCA AAAAGCCTAT
GCGCAAATCG AATTGGCTCG AACGAATAAT GCGGCGACAT TTAAAAAAGA TTATGCTGCC
TATGTTAATT TGGCCCGTGA TTTGGCTCAG AACATTGGTG CTGATTTTTC TCTGGACGAT
GGAACAGGTT ATGGCATAGT CACTCATGAT TGGATTACAA AAAATTGGTG GGGAGATCAT
ACAGATCCTT ATGGTTATTT AGCGCGTGGG GGATTAGTAA AGCGCATTGG CACNAGATTT
ACAACGGGCG TTTCNGNAAC AGGTGAGACT GGTCATTATT CAGCCAGGTA A

EF071-2 (SEQ ID NO:270)
MF KKLMIQLALV
IGLSLTIPMT AXAYTIEADP INFTYFPGSA SNELIVLHES GNERNLGPHS LDNEVAYMKR
NWSNAYVSYF VGSGGRVKQL APAGQIQYGA GSLANQKAYA QIELARTNNA ATFKKDYAAY
VNLARDLAQN IGADFSLDDG TGYGIVTHDW ITKNWWGDHT DPYGYLARGG LVKRIGTRFT
TGVSXTGETG HYSAR

EF071-3 (SEQ ID NO:271)
G TTTAAAAAAT TAATGATTCA ACTTGCTTTA
GTGATTGGTT TAAGTTTAAC GATTCCGATG ACGGCTTNCG CTTACACCAT CGAAGCGGAT
CCAATCAACT TTACTTATTT TCCCGGCTCT GCAAGCAATG AATTAATTGT TTTACATGAA
TCTGGAAACG AGCGGAACCT AGGACCACAC AGTTTAGACA ATGAAGTGGC CTATATGAAA
CGAAATTGGT CAAATGCTTA TGTCTCATAT TTTGTCGGAT CTGGTGGACG AGTGAAACAA
TTAGCTCCTG CTGGCCAAAT TCAATATGGC GCAGGTTCTT TAGCTAATCA AAAAGCCTAT
GCGCAAATCG AATTGGCTCG AACGAATAAT GCGGCGACAT TTAAAAAAGA TTATGCTGCC
TATGTTAATT TGGCCCGTGA TTTGGCTCAG AACATTGGTG CTGATTTTTC TCTGGACGAT
GGAACAGGTT ATGGCATAGT CACTCATGAT TGGATTACAA AAAATTGGTG GGGAGATCAT
ACAGATCCTT ATGGTTATTT AGCGCGTGGG GGATTAGTAA AGCGCATTGG CACNAGATTT
ACAACGGGCG TTTCNGNAAC AGGTGAGACT GGTCATTATT CAGCCAGGT

EF071-4 (SEQ ID NO:272)
F KKLMIQLALV
IGLSLTIPMT AXAYTIEADP INFTYFPGSA SNELIVLHES GNERNLGPHS LDNEVAYMKR
NWSNAYVSYF VGSGGRVKQL APAGQIQYGA GSLANQKAYA QIELARTNNA ATFKKDYAAY
VNLARDLAQN IGADFSLDDG TGYGIVTHDW ITKNWWGDHT DPYGYLARGG LVKRIGTRFT
TGVSXTGETG HYSAR

EF072-1 (SEQ ID NO:273)
TAATCAATGA AAAACGCACG TTGGTTAAGT ATTTGCGTCA TGCTACTCGC TCTTTTCGGG
TTTTCACAGC AAGCATTAGC AGAGGCATCG CAAGCAAGCG TTCAAGTTAC GTTGCACAAA
TTATTGTTCC CTGATGGTCA ATTACCAGAA CAGCAGCAAA ACACAGGGGA AGAGGGAACG
CTGCTTCAAA ATTATCGGGG CTTAAATGAC GTCACTTATC AAGTCTATGA TGTGACGGAT
CCGTTTTATC AGCTTCGTTC TGAAGGAAAA ACGGTCCAAG AGGCACAGCG TCAATTAGCA
GAAACCGGTG CAACAAATAG AAAACCGATC GCAGAAGATA AAACACAGAC AATAAATGGA
GAAGATGGAG TGGTTTCTTT TTCATTAGCT AGCAAAGATT CGCAGCAACG AGATAAAGCC
TATTTATTTG TTGAAGCGGA AGCACCAGAA GTGGTAAAGA AAAAGCTAG CAACCTAGTA
GTGATTTTGC CTGTTCAAGA TCCACAAGGG CAATCGTTAA CGCATATTCA TTTATATCCA
AAAAATGAAG AAAATGCCTA TGACTTACCA CCACTTGAAA AACGGTACT CGATAAGCAA
CAAGGCTTTA ATCAAGGAGA GCACATTAAC TATCAGTTAA CGACTCAGAT TCCAGCGAAT
ATTTTAGGAT ATCAGGAATT CCGTTTGTCA GATAAGGCGG ATACAACGTT GACACTTTTA
CCAGAATCAA TTGAGGTAAA AGTGGCTGGA AAAACAGTTA CTACAGGTTA CACACTGACG
ACGCAAAAGC ATGGATTTAC GCTTGATTTT TCAATTAAAG ACTTACAAAA CTTTGCAAAT
CAAACAATGA CTGTGTCGTA TCAAATGCGT TTAGAAAAGA CCGCTGAACC TGACACTGCG
ATTAACAACG AAGGACAATT AGTCACGGAC AAACATCTT TGACTAAAAG AGCCACAGTT
CGTACAGGCG GCAAGTCTTT TGTCAAAGTT GATAGTGAAA ATGCGAAAAT CACCTTGCCA
GAGGCTGTTT TTATCGTCAA AAATCAAGCG GGGGAATACC TCAATGAAAC AGCAAACGGG
TATCGTTGGC AAAAAGAAAA AGCATTAGCT AAAAAATTCA CGTCTAATCA AGCCGGTGAA
TTTTCAGTTA AAGGNNTTAA AAGATGGCCA GTACTTCTTG GAAGAAATCT CTGCACCAAA
AGGTTATCTT CTGAATCAAA CAGAAATTCC TTTTACGGTG GGAAAAAATT CTTATGCAAC
GAACGGACAA CGAACAGCAC CGTTACATGT AATCAATAA

EF072-2 (SEQ ID NO:274)
MKNARWLSI CVMLLALFGF SQQALAEASQ ASVQVTLHKL LFPDGQLPEQ QQNTGEEGTL
LQNYRGLNDV TYQVYDVTDP FYQLRSEGKT VQEAQRQLAE TGATNRKPIA EDKTQTINGE
DGVVSFSLAS KDSQQRDKAY LFVEAEAPEV VKEKASNLVV ILPVQDPQGQ SLTHIHLYPK
NEENAYDLPP LEKTVLDKQQ GFNQGEHINY QLTTQIPANI LGYQEFRLSD KADTTLTLLP
ESIEVKVAGK TVTTGYTLTT QKHGFTLDFS IKDLQNFANQ TMTVSYQMRL EKTAEPDTAI
NNEGQLVTDK HTLTKRATVR TGGKSFVKVD SENAKITLPE AVFIVKNQAG EYLNETANGY

TABLE 1-continued

Nucleotide and Amino Acid Seqeuences of E. faecalis Genes.

RWQKEKALAK KFTSNQAGEF SVKGXKRWPV LLGRNLCTKR LSSESNRNSF YGGKKFLCNE
RTTNSTVTCN Q

EF072-3 (SEQ ID NO:275)
ATTACCAGAA CAGCAGCAAA ACACAGGGGA AGAGGGAACG
CTGCTTCAAA ATTATCGGGG CTTAAATGAC GTCACTTATC AAGTCTATGA TGTGACGGAT
CCGTTTTATC AGCTTCGTTC TGAAGGAAAA ACGGTCCAAG AGGCACAGCG TCAATTAGCA
GAAACCGGTG CAACAAATAG AAAACCGATC GCAGAAGATA AAACACAGAC AATAAATGGA
GAAGATGGAG TGGTTTCTTT TTCATTAGCT AGCAAAGATT CGCAGCAACG AGATAAAGCC
TATTTATTTG TTGAAGCGGA AGCACCAGAA GTGGTAAAGG AAAAAGCTAG CAACCTAGTA
GTGATTTTGC CTGTTCAAGA TCCACAAGGG CAATCGTTAA CGCATATTCA TTTATATCCA
AAAAATGAAG AAAATGCCTA TGACTTACCA CCACTTGAAA AAACGGTACT CGATAAGCAA
CAAGGCTTTA ATCAAGGAGA GCACATTAAC TATCAGTTGA CGACTCAGAT TCCAGCGAAT
ATTTTAGGAT ATCAGGAATT CCGTTTGTCA GATAAGGCGG ATACAACGTT GACACTTTTA
CCAGAATCAA TTGAGGTAAA AGTGGCTGGA AAAACAGTTA CTACAGGTTA CACACTGACG
ACGCAAAAGC ATGGATTTAC GCTTGATTTT TCAATTAAAG ACTTACAAAA CTTTGCAAAT
CAAACAATGA CTGTGTCGTA TCAAATGCGT TTAGAAAAGA CCGCTGAACC TGACACTGCG
ATTAACAACG AAGGACAATT AGTCACGGAC AAACATACCT TGACTAAAAG AGCCACAGTT
CGTACAGGCG GCAAGTCTTT TGTCAAAGTT GATAGTGAAA ATGCGAAAAT CACCTTGCCA
GAGGCTGTTT TTATCGTCAA AAATCAAGCG GGGGAATACC TCAATGAAAC AGCAAACGGG
TATCGTTGGC AAAAAGAAAA AGCATTAGCT AAAAAATTCA CGTCTAATCA AGCCGGTGAA
TTTTCAGTTA AAGGNNTTAA AAGATGGCCA GTACTTCTTG GAAGAAATCT CTGCACCAAA
AGGTTATCTT CTGAATCAAA CAGAAATTCC TTTTACGGTG GGAAAAAATT CTTATGCAAC
GAACGGACAA CGAACAGCAC CGTTACATGT A

EF072-4 (SEQ ID NO:276)
QLPEQ QQNTGEEGTL
LQNYRGLNDV TYQVYDVTDP FYQLRSEGKT VQEAQRQLAE TGATNRKPIA EDKTQTINGE
DGVVSFSLAS KDSQQRDKAY LFVEAEAPEV VKEKASNLVV ILPVQDPQGQ SLTHIHLYPK
NEENAYDLPP LEKTVLDKQQ GFNQGEHINY QLTTQIPANI LGYQEFRLSD KADTTLTLLP
ESIEVKVAGK TVTTGYTLTT QKHGFTLDFS IKDLQNFANQ TMTVSYQMRL EKTAEPDTAI
NNEGQLVTDK HTLTKRATVR TGGKSFVKVD SENAKITLPE AVFIVKNQAG EYLNETANGY
RWQKEKALAK KFTSNQAGEF SVKGXKRWPV LLGRNLCTKR LSSESNRNSF YGGKKFLCNE
RTTNSTVTC

EF073-1 (SEQ ID NO:277)
TAAATGAACA AATTAAATAC AAAATTACTG ATTGGCTATA TTCTTTTAGG AGCCTTAATC
ATTGCTGTCG CTAGAGAATA TGGCTTCTTC GCTTTTGTGA TTCTGGTAGG CTTTTTAGTA
TTCGTTCTCT ATCGAAAAAA GAAAAATGCC GCCGACAAAA GCGATCAAAT GCCTTACTTA
ACGAAAGATA AGAAGCCCA TTATCGTGAG TTGGGGTTAT CTCCACAAGA AATTGATTTT
TTCAGAAGTA CAATGAGCAC AGCCAAAAAA CAAATCATAC AATTGCAAGA AAACATGAAT
CGTTCAACTA AATTACGGGC GATTGACTTA CGTAATGATA CTACGAAGGT TTCTAAAGCT
CTGTTTAAAG AGTTAGTGAA AGAACCTAAA AAGTTACACT TAGCCAATCA CTTTCTCTAT
ACACATTTAC CAAATATCGT TGACTTAACA AGTAAACATT TAGAAATCGA ACAACACGAA
GTAAAAAACA AACAAACGTA TGAAAAATTA GAAGAAAGCG CACAAATCAT TGACCAATTG
TCAAAATTAG TTAAAAATGA TTATGAGGAA ATCGTTTCCG ATGACTTAGA CGATTTAGAT
GTCGAAATGT CGATCGCTAA AAGCAGCTTG TCGCAAAAAG CTGCAACTGA GGAATCACCT
CAAGTAAACG AAGACCAGCA ATAA

EF073-2 (SEQ ID NO:278)
MNKLNTKLLI GYILLGALII AVAREYGFFA FVILVGFLVF VLYRKKKNAA DKSDQMPYLT
KDKEAHYREL GLSPQEIDFF RSTMSTAKKQ IIQLQENMNR STKLRAIDLR NDTTKVSKAL
FKELVKEPKK LHLANHFLYT HLPNIVDLTS KHLEIEQHEV KNKQTYEKLE ESAQIIDQLS
KLVKNDYEEI VSDDLDDLDV EMSIAKSSLS QKAATEESPQ VNEDQQ

EF073-3 (SEQ ID NO:279)
CT ATCGAAAAAA GAAAAATGCC GCCGACAAAA GCGATCAAAT GCCTTACTTA
ACGAAAGATA AGAAGCCCA TTATCGTGAG TTGGGGTTAT CTCCACAAGA AATTGATTTT
TTCAGAAGTA CAATGAGCAC AGCCAAAAAA CAAATCATAC AATTGCAAGA AAACATGAAT
CGTTCAACTA AATTACGGGC GATTGACTTA CGTAATGATA CTACGAAGGT TTCTAAAGCT
CTGTTTAAAG AGTTAGTGAA AGAACCTAAA AAGTTACACT TAGCCAATCA CTTTCTCTAT
ACACATTTAC CAAATATCGT TGACTTAACA AGTAAACATT TAGAAATCGA ACAACACGAA
GTAAAAAACA AACAAACGTA TGAAAAATTA GAAGAAAGCG CACAAATCAT TGACCAATTG
TCAAAATTAG TTAAAAATGA TTATGAGGAA ATCGTTTCCG ATGACTTAGA CGATTTAGAT
GTCGAAATGT CGATCGCTAA AAGCAGCTTG TCGCAAAAAG CTGCAACTGA GGAATCACCT
CAAGTAAACG AAGACCAGCA AT

EF073-4 (SEQ ID NO:280)
YRKKKNAA DKSDQMPYLT
KDKEAHYREL GLSPQEIDFF RSTMSTAKKQ IIQLQENMNR STKLRAIDLR NDTTKVSKAL
FKELVKEPKK LHLANHFLYT HLPNIVDLTS KHLEIEQHEV KNKQTYEKLE ESAQIIDQLS
KLVKNDYEEI VSDDLDDLDV EMSIAKSSLS QKAATEESPQ VNEDQQ

EF074-1 (SEQ ID NO:281)
TAAAGGAGTT CTCAAAAAAT GAAGCTAAAA AAAATAATTC CTGCTTTTCC CCTTCTTTCA
ACCGTTGCAG TTGGCTTGTG GTTAACGCCT ACTCAAGCTT CTGCAGATGC TGCGGATACG
ATGGTAGATA TCTCTGGCAA AAAAGTGTTG GTTGGATATT GGCATAACTG GGCCTCAAAA

TABLE 1-continued

Nucleotide and Amino Acid Seqeuences of E. faecalis Genes.

```
GGACGCGATG GTTACAAACA AGGAACATCA GCATCACTAA ACCTTTCAGA AGTAAATCAA
GCCTACAATG TCGTACCGGT TTCCTTCATG AAAAGCGATG GCACGACACG GATTCCTACG
TTCAAGCCTT ATAACCAAAC GGACACTGCC TTCCGACAAG AAGTCGCACA ATTAAATAGT
CAAGGTCGCG CAGTTTTATT GGCACTTGGT GGAGCAGATG CACATATTCA ATTAGTCAAA
GGCGATGAAC AAGCCTTTGC GAATGAAATC ATTCGTCAAG TGGAAACATA CGGCTTTGAT
GGTTTAGACA TCGACTTAGA GCAATTGGCG ATTACTGCTG GCGACAACCA AACCGTCATC
CCTGCTACGT TGAAAATAGT CAAAGACCAT TATCGAGCAC AAGGAAAAAA TTTCATCATT
ACGATGGCAC CAGAATTCCC TTATTTAAAA CCTGGTGCCG CTTATGAAAC ATACATTACT
TCCCTAAATG GTTATTATGA TTACATTGCC CCACAATTAT ATAACCAAGG CGGCGACGGT
GTCTGGGTTG ATGAAGTTAT GACTTGGGTT GCTCAAAGCA ACGATGCTCT AAAATACGAG
TTCCTCTATN ATATT
```

EF074-2 (SEQ ID NO:282)
MKLKK IIPAFPLLST VAVGLWLTPT QASADAADTM VDISGKKVLV GYWHNWASKG
RDGYKQGTSA SLNLSEVNQA YNVVPVSFMK SDGTTRIPTF KPYNQTDTAF RQEVAQLNSQ
GRAVLLALGG ADAHIQLVKG DEQAFANEII RQVETYGFDG LDIDLEQLAI TAGDNQTVIP
ATLKIVKDHY RAQGKNFIIT MAPEFPYLKP GAAYETYITS LNGYYDYIAP QLYNQGGDGV
WVDEVMTWVA QSNDALKYEF LYXI

EF074-3 (SEQ ID NO:283)
TGC TGCGGATACG
```
ATGGTAGATA TCTCTGGCAA AAAAGTGTTG GTTGGATATT GGCATAACTG GGCCTCAAAA
GGACGCGATG GTTACAAACA AGGAACATCA GCATCACTAA ACCTTTCAGA AGTAAATCAA
GCCTACAATG TCGTACCGGT TTCCTTCATG AAAAGCGATG GCACGACACG GATTCCTACG
TTCAAGCCTT ATAACCAAAC GGACACTGCC TTCCGACAAG AAGTCGCACA ATTAAATAGT
CAAGGTCGCG CAGTTTTATT GGCACTTGGT GGAGCAGATG CACATATTCA ATTAGTCAAA
GGCGATGAAC AAGCCTTTGC GAATGAAATC ATTCGTCAAG TGGAAACATA CGGCTTTGAT
GGTTTAGACA TCGACTTAGA GCAATTGGCG ATTACTGCTG GCGACAACCA AACCGTCATC
CCTGCTACGT TGAAAATAGT CAAAGACCAT TATCGAGCAC AAGGAAAAAA TTTCATCATT
ACGATGGCAC CAGAATTCCC TTATTTAAAA CCTGGTGCCG CTTATGAAAC ATACATTACT
TCCCTAAATG GTTATTATGA TTACATTGCC CCACAATTAT ATAACCAAGG CGGCGACGGT
GTCTGGGTTG ATGAAGTTAT GACTTGGGTT GCTCAAAGCA ACGATGCTCT AAAATACGAG
TTCCTCT
```

EF074-4 (SEQ ID NO:284)
AADTM VDISGKKVLV GYWHNWASKG
RDGYKQGTSA SLNLSEVNQA YNVVPVSFMK SDGTTRIPTF KPYNQTDTAF RQEVAQLNSQ
GRAVLLALGG ADAHIQLVKG DEQAFANEII RQVETYGFDG LDIDLEQLAI TAGDNQTVIP
ATLKIVKDHY RAQGKNFIIT MAPEFPYLKP GAAYETYITS LNGYYDYIAP QLYNQGGDGV
WVDEVMTWVA QSNDALKYEF LY

EF075-1 (SEQ ID NO:285)
```
TAACCTATAA GAAAAAAATC ACAACCTGTG ATAAATTATT GGAGGNAAAA TATGTCAAAA
GGGAAGAAAA TTTTTGCCAT TATCNTTGGA ATTATCTTGG NTCTATTTCT TGCAGTTGTT
GGAATGGGAG CAAAACTTTA TTGGGATGTT TCTAAATCAA TGGATAAAAC CTATGAAACA
GTAGAACGAT CTAAAAAAAG TCAGGTCAAT TTAAACAATA AGGAGCCTTT TTCTGTTTTA
TTATTAGGGA TTGATACAGG CGATGATGGG CGTGTCGAGC AAGGTCGTTC GGATACAACA
ATTGTTGCAA CAGTTAATCC TCGTGACAAG CAAACAACCT TAGTCAGTCT TGCTCGCGAT
ACCTATGTTG ATATTCCAGG TCAAGGAAAA CAAGATAAAT TGAATCACGC CTATGCTTTT
GGTGGCGCAT CTTTAGCAAT GGACACAGTT GAAAACTATT TAAACATACC TATTAATCAT
TATGTTTCAA TTAATATGGC TGGTTTAAAA GAATTAGTCA ACGCGGTTGG CGGAATCGAA
GTGAACAATA ATCTGACTTT TTCTCAAGAC GGATATGATT TTACGATTGG TAAAATTTCA
TTGGATGGTG AACAAGCACT CTCCTATTCA AGAATGCGTT ACGAAGACCC TAATGGTGAC
TACGGCCGCC AAGAACGTCA AAGAAAAGTG ATTGAAGGCA TCGTCCAAAA AGTCTTAAGT
CTTAACAGCG TAAGCAACTA TCAAGAAATT TTAACAGCTG TTTCTGATAA TATGAAGACA
GATTTAAGTT TTGATGACAT GAAAAAATT GCCTTAGATT ATCGCAGTGC CTTTGGTAAA
GTGAAACAAG ACCAACTTCA AGGTACTGGT TTTATGCAAG ATGGTGTTTC CTATCAACGT
GTGGATGAAC AAGAATTAAC TCGTGTCCAA CAAGAGTTGA AAAATCAATT GAATACAAAA
TAA
```

EF075-2 (SEQ ID NO:286)
MSKG KKIFAIIXGI ILXLFLAVVG MGAKLYWDVS KSMDKTYETV
ERSKKSQVNL NNKEPFSVLL LGIDTGDDGR VEQGRSDTTI VATVNPRDKQ TTLVSLARDT
YVDIPGQGKQ DKLNHAYAFG GASLAMDTVE NYLNIPINHY VSINMAGLKE LVNAVGGIEV
NNNLTFSQDG YDFTIGKISL DGEQALSYSR MRYEDPNGDY GRQERQRKVI EGIVQKVLSL
NSVSNYQEIL TAVSDNMKTD LSFDDMKKIA LDYRSAFGKV KQDQLQGTGF MQDGVSYQRV
DEQELTRVQQ ELKNQLNTK

EF075-3 (SEQ ID NO:287)
```
ACTTTA TTGGGATGTT TCTAAATCAA TGGATAAAAC CTATGAAACA
GTAGAACGAT CTAAAAAAAG TCAGGTCAAT TTAAACAATA AGGAGCCTTT TTCTGTTTTA
TTATTAGGGA TTGATACAGG CGATGATGGG CGTGTCGAGC AAGGTCGTTC GGATACAACA
ATTGTTGCAA CAGTTAATCC TCGTGACAAG CAAACAACCT TAGTCAGTCT TGCTCGCGAT
ACCTATGTTG ATATTCCAGG TCAAGGAAAA CAAGATAAAT TGAATCACGC CTATGCTTTT
GGTGGCGCAT CTTTAGCAAT GGACACAGTT GAAAACTATT TAAACATACC TATTAATCAT
TATGTTTCAA TTAATATGGC TGGTTTAAAA GAATTAGTCA ACGCGGTTGG CGGAATCGAA
GTGAACAATA ATCTGACTTT TTCTCAAGAC GGATATGATT TTACGATTGG TAAAATTTCA
```

TABLE 1-continued

Nucleotide and Amino Acid Seqeuences of E. faecalis Genes.

```
TTGGATGGTG AACAAGCACT CTCCTATTCA AGAATGCGTT ACGAAGACCC TAATGGTGAC
TACGGCCGCC AAGAACGTCA AAGAAAAGTG ATTGAAGGCA TCGTCCAAAA AGTCTTAAGT
CTTAACAGCG TAAGCAACTA TCAAGAAATT TTAACAGCTG TTTCTGATAA TATGAAGACA
GATTTAAGTT TTGATGACAT GAAAAAAATT GCCTTAGATT ATCGCAGTGC CTTTGGTAAA
GTGAAACAAG ACCAACTTCA AGGTACTGGT TTTATGCAAG ATGGTGTTTC CTATCAACGT
GTGGATGAAC AAGAATTAAC TCGTGTCCAA CAAGAGTTGA AAAATCAATT GAATACAAAA

EF075-4 (SEQ ID NO:288)
KLYWDVS KSMDKTYETV
ERSKKSQVNL NNKEPFSVLL LGIDTGDDGR VEQGRSDTTI VATVNPRDKQ TTLVSLARDT
YVDIPGQGKQ DKLNHAYAFG GASLAMDTVE NYLNIPINHY VSINMAGLKE LVNAVGGIEV
NNNLTFSQDG YDFTIGKISL DGEQALSYSR MRYEDPNGDY GRQERQRKVI EGIVQKVLSL
NSVSNYQEIL TAVSDNMKTD LSFDDMKKIA LDYRSAFGKV KQDQLQGTGF MQDGVSYQRV
DEQELTRVQQ ELKNQLNTK

EF076-1 (SEQ ID NO:289)
TAGAAAATAA CAGAGGAGCT GAAGGAAATG AAAGCATCAA CAAAAATTGG TATCGGTTTA
AGCATTGCTG CAGTTGCAAG TGTCTCTGTT GCAGTCATCG CTTCTGAAAA AATTATTAAG
AAGGTATCTC ATGTTTCCAA TCGTTATAAA GTTAAAAAGT TTGTAGACGA TAAATTTGAT
GGAAACCAAA AATTATTATC GATTGTCGAT GATTTATCCG ATGATGAATT AGATTCTGTT
TTAAATGTTG TGGATCGTGT GAAAGATGGC GGTTCAAAAT TAGCTGAATA TGGCGAAAAA
GTTAAAGACA ATACAGATTC TTTAAAAGAA CGCTTTTTCA CATTTATTGA AGATGCAATG
AAGTTAAAAA AGTGGCCTAG GCCATCTTTT TTTTATAAAA ATAATTCTTT TGTTTCAACA
TAA

EF076-2 (SEQ ID NO:290)
MK ASTKIGIGLS TAAVASVSVA VIASEKIIKK VSHVSNRYKV KKFVDDKFDG
NQKLLSIVDD LSDDELDSVL NVVDRVKDGG SKLAEYGEKV KDNTDSLKER FFTFIEDAMK
LKKWPRPSFF YKNNSFVST

EF076-3 (SEQ ID NO:291)
CATCG CTTCTGAAAA AATTATTAAG
AAGGTATCTC ATGTTTCCAA TCGTTATAAA GTTAAAAAGT TTGTAGACGA TAAATTTGAT
GGAAACCAAA AATTATTATC GATTGTCGAT GATTTATCCG ATGATGAATT AGATTCTGTT
TTAAATGTTG TGGATCGTGT GAAAGATGGC GGTTCAAAAT TAGCTGAATA TGGCGAAAAA
GTTAAAGACA ATACAGATTC TTTAAAAGAA CGCTTTTTCA CATTTATTGA AGATGCAATG
AAGTTAAAAA AGTGGCCTAG GCCATCTTTT TTTTATAAAA ATAATTCTT

EF076-4 (SEQ ID NO:292)
VIASEKIIKK VSHVSNRYKV KKFVDDKFDG
NQKLLSIVDD LSDDELDSVL NVVDRVKDGG SKLAEYGEKV KDNTDSLKER FFTFIEDAMK
LKKWPRPSFF YKNNS

EF077-1 (SEQ ID NO:293)
TAATGTAAAG TGAATGATGG GAGAGAAAAA GAGATGAAGC ATGTAACAAA ATTGGGGATT
ACAATTATAA CAGGAGTTTT GGCATTATTA TTTGAATTTA TTTTACATCA GCCGAATTGG
GCGTATGGCA TTATTTTAAT AACAGGTTCT GTAATGGCAT TAATGATGTT CTGGGAAATG
ATTCAAACCT TACGTGAAGG AAAATATGGT GTCGATATTT TAGCGATTAC CGCTATCGTT
GCAACCTTAG CTGTGGGAGA ATACTGGGCC AGTTTGATGA TTTTAATTAT GTTGACTGGT
GGTGATTCAT TAGAAGACTA TGCCGCTGGA AAAGCTAACC AAGAGCTGAA GTCATTATTG
GATAACTCGC CACAAAAAGC TCATCGCTTG AATGGCGAAA ATTTAGAAGA TGTTTCTGTT
GAGGAAATCA ATGTTGGCGA TGAATTAGTA GTAAAACCAG GGAACTAGT TCCAGTTGAT
GGCTTGGTAA AAACCGGGAC ATCAACAGTC GATGAATCTT CATTAACAGG AGAATCAAAA
CCAATTGAAA AAAATCCTGG GGATGAATTA ATGTCGGGTT CCGTGAATGG TGACGGCTCT
TTGAAAATGG TTGCTGAAAA AACTGTAGCA GACAGTCAAT ATCAAACAAT TGTGAACTTA
GTGAAAGAAT CTGCGGCGCG TCCAGCTCAT TTTGTACGTT TAGCAGATCG CTATGCGGTA
CCTTTTACAC TAGTTGCCTA CCTAATTGCA GGTGTTGCTT GGTTTGTTTC AAAAAGTCCG
ACACGTTTTG CGGAAGTCTT AGTTGTTGCT TCGCCGTGTC CTTTAATTCT ATCTGCCCCA
ATTGCTTTAG TGGCAGGGAT GGGTCGTTCA AGTCGTCATG GGTCGTTAT TAAATCGGGA
ACGATGGTCG AAAAATTAGC TTCTGCAAAA ACGATTGCGT TGATAAAAC AGGCACGATT
ACGCAAGGAC AACTTTCTGT TGATCAAGTC CAACCAATCA ATGCTGGAAT AACTGCTGCT
GAATTAGTGG GATTGGCAGC AAGCGTGAA CAAGAATCAA GTCATATTTT AGCTAGATCA
ATTGTTGCTT ATGCCAGAAA GCAAGATGTC CCATTAAAAA ATATTACAGA TCTAGCGGAA
GTTTCTGGTG CTGGCGTGAA GGCATTTGTG GATGGTGCTG AGATACGGGT AGGTAAAAAG
AATTTTGTGA CACAAGAGTC TCAAGAAACT GAAAAAATTG ATAAAACGAC TATTCATATT
TCACGTAATG GCACATATTT AGGCCGAATT ACTTTTACAG ACACTGTACG CCCAGAAGCA
AAAGAGACTA TGGAAAAATT ACACCAATTA CATCTTCAAC GAATTTTAAT GCTGACGGGG
GATCAAGAAT CCGTTGCAGA AACGATTGCT GCAGAAGTAG GAATTACCGA AGTACATGGG
GAATGTTTAC CACAAGATAA ATTAACTATT CTAAAAGAAT TGCCTAAAGA AAATCATCCA
GTCATCATGG TAGGAGATGG TGTAAATGAT GCACCTTCGC TTGCTGCTGC AGACGTAGGT
ATTGCTATGG GTGCTCATGG AGCTACTGCG GCTAGTGAAA CTGCTGACGT TGTTATTTTA
AAAGATGACT TAAGTAAAGT CAGCCAAGCG GTCGAAATTG CCCAAGATAC CATGAAAATT
GCCAAACAAT CTGTATTAAT CGGAATTTTT ATCTGCGTTT TACTAATGTT AATTGCTAGT
ACCGGGATCA TTCCGGCGCT AATCGGGCT ATGCTACAAG AAGTCGTGGA CACTGTGTCA
ATCTTATCTG CTTTGCGTGC TCGTCGAATT GGCCAGTAA

EF077-2 (SEQ ID NO:294)
```

TABLE 1-continued

Nucleotide and Amino Acid Seqeuences of *E. faecalis* Genes.

MKHVTKLGIT IITGVLALLF EFILHQPNWA YGITLITGSV MALMNFWEMI
QTLREGKYGV DILAITAIVA TLAVGEYWAS LMILIMLTGG DSLEDYAAGK ANQELKSLLD
NSPQKAHRLN GENLEDVSVE EINVGDELVV KPGELVPVDG LVKTGTSTVD ESSLTGESKP
IEKNPGDELM SGSVNGDGSL KMVAEKTVAD SQYQTIVNLV KESAARPAHF VRLADRYAVP
FTLVAYLIAG VAWFVSKSPT RFAEVLVVAS PCPLILSAPI ALVAGMGRSS RHGVVIKSGT
MVEKLASAKT IAFDKTGTIT QGQLSVDQVQ PINAGITAAE LVGLAASVEQ ESSHTLARSI
VAYARKQDVP LKNITDLAEV SGAGVKAFVD GAEIRVGKKN FVTQESQETE KIDKTTIHIS
RNGTYLGRIT FTDTVRPEAK ETMEKLHQLH LQRILMLTGD QESVAETIAA EVGITEVHGE
CLPQDKLTIL KELPKENHPV IMVGDGVNDA PSLAAADVGI AMGAHGATAA SETADVVILK
DDLSKVSQAV EIAQDTMKIA KQSVLIGIFI CVLLMLIAST GIIPALIGAM LQEVVDTVSI
LSALRARRIG Q

EF077-3 (SEQ ID NO:295)
TCA GCCGAATTGG
GCGTATGGCA TTATTTTAAT AACAGGTTCT GTAATGGCGT TAATGATGTT CTGGGAAATG
ATTCAAACCT TACGTGAAGG AAAATATGGT GTCGATATTT TAGCGATTAC CGCTATCGTT
GCAACCTTAG CTGTGGGAGA ATACTGGGCC AGTTTGATGA TTTTAATTAT GTTGACTGGT
GGTGATTCAT TAGAAGACTA TGCCGCTGGA AAAGCTAACC AAGAGCTGAA GTCATTATTG
GATAACTCGC CACAAAAAGC TCATCGCTTG AATGGCGAAA ATTTAGAAGA TGTTTCTGTT
GAGGAAATCA ATGTTGGCGA TGAATTAGTA GTAAAACCAG GGGAACTAGT TCCAGTTGAT
GGCTTGGTAA AAACCGGGAC ATCAACAGTC GATGAATCTT CATTAACAGG AGAATCAAAA
CCAATTGAAA AAAATCCTGG GGATGAATTA ATGTCGGGTT CCGTGAATGG TGACGGCTCT
TTGAAAATGG TTGCTGAAAA AACTGTAGCA GACAGTCAAT ATCAAACAAT TGTGAACTTA
GTGAAAGAAT CTGCGGCGCG TCCAGCTCAT TTTGTACGTT TAGCAGATCG CTATGCGGTA
CCTTTTACAC TAGTTGCCTA CCTAATTGCA GGTGTTGCTT GGTTTGTTTC AAAAAGTCCG
ACACGTTTTG CGGAAGTCTT AGTTGTTGCT TCGCCGTGTC CTTTAATTCT ATCTGCCCCA
ATTGCTTTAG TGGCAGGGAT GGGTCGTTCA AGTCGTCATG GGTCGTTAT TAAATCGGGA
ACGATGGTCG AAAAATTAGC TTCTGCAAAA ACGATTGCGT TTGATAAAAC AGGCACGATT
ACGCAAGGAC AACTTTCTGT TGATCAAGTC CAACCAATCA ATGCTGGAAT AACTGCTGCT
GAATTAGTGG GATTGGCAGC AAGCGTGGAA CAAGAATCAA GTCATATTTT AGCTAGATCA
ATTGTTGCTT ATGCCAGAAA GCAAGATGTC CCATTAAAAA ATATTACAGA TCTAGCGGAA
GTTTCTGGTG CTGGCGTGAA GGCATTTGTG GATGGTGCTG AGATACGGGT AGGTAAAAAG
AATTTTGTGA CACAAGAGTC TCAAGAAACT GAAAAAATTG ATAAAACGAC TATTCATATT
TCACGTAATG GCACATATTT AGGCCGAATT ACTTTTACAG ACACTGTACG CCCAGAAGCA
AAAGAGACTA TGGAAAAATT ACACCAATTA CATCTTCAAC GAATTTTAAT GCTGACGGGG
GATCAAGAAT CCGTTGCAGA AACGATTGCT GCAGAAGTAG GAATTACCGA AGTACATGGG
GAATGTTTAC CACAAGATAA ATTAACTATT CTAAAAGAAT TGCCTAAAGA AAATCATCCA
GTCATCATGG TAGGAGATGG TGTAAATGAT GCACCTTCGC TTGCTGCTGC AGACGTAGGT
ATTGCTATGG GTGCTCATGG AGCTACTGCG GCTAGTGAAA CTGCTGACGT TGTTATTTTA
AAAGATGACT TAAGTAAAGT CAGCCAAGCG GTCGAAATTG CCCAAGATAC CATGAAAATT
GCCAAACAAT CTGTATTAAT CGGAATTTTT ATCTGCGTTT TACTAATGTT AATTGCTAGT
ACCGGGATCA TTCCGGCGCT AATCGGGGCT ATGCTACAAG AAGTCGTGGA CACTGTGTCA
ATCTTATCTG CTTTGCGTGC TCGTCGAATT GGCC

EF077-4 (SEQ ID NO:296)
QPNWA YGIILITGSV MALMMFWEMI
QTLREGKYGV DILAITAIVA TLAVGEYWAS LMILIMLTGG DSLEDYAAGK ANQELKSLLD
NSPQKAHRLN GENLEDVSVE EINVGDELVV KPGELVPVDG LVKTGTSTVD ESSLTGESKP
IEKNPGDELM SGSVNGDGSL KMVAEKTVAD SQYQTIVNLV KESAARPAHF VRLADRYAVP
FTLVAYLIAG VAWFVSKSPT RFAEVLVVAS PCPLILSAPI ALVAGMGRSS RHGVVIKSGT
MVEKLASAKT IAFDKTGTIT QGQLSVDQVQ PINAGITAAE LVGLAASVEQ ESSHILARSI
VAYARKQDVP LKNITDLAEV SGAGVKAFVD GAEIRVGKKN FVTQESQETE KIDKTTIHIS
RNGTYLGRIT FTDTVRPEAK ETMEKLHQLH LQRILMLTGD QESVAETIAA EVGITEVHGE
CLPQDKLTIL KELPKENHPV IMVGDGVNDA PSLAAADVGI AMGAHGATAA SETADVVILK
DDLSKVSQAV EIAQDTMKIA KQSVLIGIFI CVLLMLIAST GIIPALIGAM LQEVVDTVSI
LSALRARRIG

EF079-1 (SEQ ID NO:297)
TAATTTCTAG CATCACCGAA GAAATTTTTA GAAAAACAAA GAGCCTGGGC CAATCACTGT
CCCAGGCTCT CATGCTTTAT TTTTAAGGAG GAAGCAATGA AGTCAAAAAA GAAACGTCGT
ATCATTGATG GTTTTATGAT TCTTTTACTG ATTATTGGAA TAGGTGCATT TGCGTATCCT
TTTGTTAGCG ATGCATTAAA TAACTATCTG GATCAACAAA TTATCGCTCA TTATCAAGCA
AAAGCAAGCC AAGAAACAC CAAAGAAATG GCTGAACTTC AAGAAAAAAT GGAAAAGAAA
AACCAAGAAT TAGCGAAAAA AGGCAGCAAT CCTGGATTAG ATCCTTTTTC TGAAACGCAA
AAAACAACGA AAAACCAGA CAAATCCTAT TTGAAAGTC ATACGATTGG TGTTTTAACC
ATTCCAAAAA TAAATGTCCG TTTACCAATT TTTGATAAAA CGAATGCATT GCTATTGGAA
AAAGGAAGCT CCTTGTTAGA AGGAACCTCC TATCCTACGA GTGGTACGAA TACACATGCG
GTCATTTCAG GCCATCGTGG TCTCCCTCAA GCCAAATTAT TTACAGATTT GCCAGAATTA
AAAAAAGGCG ATGAATTTA TATCGAAGTC AATGGGAAGA CGCTTGCTTA TCAAGTAGAT
CAAATAAAA CCGTTGAACC AACTGATACA AAAGATTTAC ACATTGAGTC TGGCCAAGAT
CTCGTCACTT TATTAACTTG CACACCGTAT ATGATAAACA GTCATCGGTT ATTAGTTCGA
GGACATCGTA TCCCATATCA ACCAGAAAAA GCAGCAGCGG GGATGAAAAA AGTGGCACAA
CAACAAAATT TACTATTATG GACATTACTT TTAATTGCCT GTGCGTTAAT TATTAGCGGC
TTCATTATCT GGTACAAGCG ACGGAAAAAG ACGACCAGAA AACCAAAGTA G

EF079-2 (SEQ ID NO:298)
MKSKKKRRI IDGFMILLLI IGIGAFAYPF

TABLE 1-continued

Nucleotide and Amino Acid Seqeuences of E. faecalis Genes.

VSDALNNYLD QQIIAHYQAK ASQENTKEMA ELQEKMEKKN QELAKKGSNP GLDPFSETQK
TTKKPDKSYF ESHTIGVLTI PKIMVRLPIF DKTNALLLEK GSSLLEGTSY PTGGTNTHAV
ISGHRGLPQA KLFTDLPELK KGDEFYIEVN GKTLAYQVDQ IKTVEPTDTK DLHIESGQDL
VTLLTCTPYM INSHRLLVRG HRIPYQPEKA AAGMKKVAQQ QNLLLWTLLL IACALIISGF
IIWYKRRKKT TRKPK

EF079-3 (SEQ ID NO:299)
TCCT
TTTGTTAGCG ATGCATTAAA TAACTATCTG GATCAACAAA TTATCGCTCA TTATCAAGCA
AAAGCAAGCC AAGAAAACAC CAAAGAAATG GCTGAACTTC AAGAAAAAAT GGAAAAGAAA
AACCAAGAAT TAGCGAAAAA AGGCAGCAAT CCTGGATTAG ATCCTTTTTC TGAAACGCAA
AAAACAACGA AAAAACCAGA CAAATCCTAT TTTGAAAGTC ATACGATTGG TGTTTTAACC
ATTCCAAAAA TAAATGTCCG TTTACCAATT TTTGATAAAA CGAATGCATT GCTATTGGAA
AAAGGAAGCT CCTTGTTAGA AGGAACCTCC TATCCTACAG GTGGTACGAA TACACATGCG
GTCATTTCAG GCCATCGTGG TCTCCCTCAA GCCAAATTAT TTACAGATTT GCCAGAATTA
AAAAAAGGCG ATGAATTTTA TATCGAAGTC AATGGGAAGA CGCTTGCTTA TCAAGTAGAT
CAAATAAAAA CCGTTGAACC AACTGATACA AAAGATTTAC ACATTGAGTC TGGCCAAGAT
CTCGTCACTT TATTAACTTG CACACCGTAT ATGATAAACA GTCATCGGTT ATTAGTTCGA
GGACATCGTA TCCCATATCA ACCAGAAAAA GCAGCAGCGG GGATGAAAAA AGTGGCACAA
CAACAAAATT TACTATTATG GACATTACTT TTAATTGCCT GTGCGTTAAT TATTAGCGGC
TTCATTATCT GGTACAAGCG ACGGAAAAAG ACGACCAGAA AACCA

EF079-4 (SEQ ID NO:300)
PF
VSDALNNYLD QQIIAHYQAK ASQENTKEMA ELQEKMEKKN QELAKKGSNP GLDPFSETQK
TTKKPDKSYF ESHTIGVLTI PKINVRLPIF DKTNALLLEK GSSLLEGTSY PTGGTNTHAV
ISGHRGLPQA KLFTDLPELK KGDEFYIEVN GKTLAYQVDQ IKTVEPTDTK DLHIESGQDL
VTLLTCTPYM INSHRLLVRG HRIPYQPEKA AAGMKKVAQQ QNLLLWTLLL IACALIISGF
IIWYKRRKKT TRKP

EF080-1 (SEQ ID NO:301)
TAGTTACACT CGTTTAGGGC TAGCAACGTT AGGCATTTTC GCTGGACTCT TAGCACTCTT
TTTATTAGGA GGTTATTTCC TATGAAAAAA CGACTTTTAC CTATTTTTTT CCTAATACTT
CTTACCTTTG GCCTTGCCCT ACCCGTTTCG GCGGCTGAAA ATTCAATTGA TGATGGCGCA
CAATTACTGA CACCTGATCA AATCAACCAA CTAAAGCAAG AGATACAACC TTTAGAAGAA
AAAACAAAAG CCTCTGTCTT TATTGTAACC ACAAATAATA ATACCTATGG CGATGAACAA
GAATATGCAG ATCATTATCT TTTAAATAAA GTTGGCAAGG ACCAAAATGC GATTCTTTTT
CTCATTGATA TGGACTTACG GAAAATCTAC ATCTCTACTT CTGGAAACAT GATTGATTAT
ATGACAGATG CACGAATTGA TGATACCTTA GATAAAATAT GGGATAATAT GAGTCAAGGA
AATTATTTCG CGGCTGCTCA AACCTTTGTT CAGGAAACTC AAGCATTTGT TAATAAAGGG
GTTCCTGGGG GCACTATCG TGTGGACAGC GAAACAGGTA AAATCACTCG TTATAAAGTC
ATTACCCCGC TGGAAATGGT AATTGCTTTT GCTGCTGCGC TGATACTCAG TTTGGTCTTC
TTAGGCATTA ATATTTCTAA ATATCAATTA AAATTTTCAA GTTATCAATA TCCCTTTAGG
GAAAAAACAA CTTTAAACTT AACCTCCCGC ACAGATCAGT TAACCAACTC TTTCATCACT
ACGCGTCGTA TTCCTAAAAA CAATGGCGGC AGTGGCGGAA TGGGCGGTGG TGGTAGCACC
ACCCACTCAA CTGGCGGCGG CACATTCGGT GGCGGCGGTC GAAGTTTTTA G

EF080-2 (SEQ ID NO:302)
MKKR LLPIFFLILL TFGLALPVSA AENSIDDGAQ
LLTPDQINQL KQEIQPLEEK TKASVFIVTT NNNTYGDEQE YADHYLLNKV GKDQNAILFL
IDMDLRKIYI STSGNMIDYM TDARIDDTLD KIWDNMSQGN YFAAAQTFVQ ETQAFVNKGV
PGGHYRVDSE TGKITRYKVI TPLEMVIAFA AALILSLVFL GINISKYQLK FSSYQYPFRE
KTTLNLTSRT DQLTNSFITT RRIPKNNGGS GMGGGGSTT HSTGGGTFGG GGRSF

EF080-3 (SEQ ID NO:303)
GGCTGAAA ATTCAATTGA TGATGGCGCA
CAATTACTGA CACCTGATCA AATCAACCAA CTAAAGCAAG AGATACAACC TTTAGAAGAA
AAAACAAAAG CCTCTGTCTT TATTGTAACC ACAAATAATA ATACCTATGG CGATGAACAA
GAATATGCAG ATCATTATCT TTTAAATAAA GTTGGCAAGG ACCAAAATGC GATTCTTTTT
CTCATTGATA TGGACTTACG GAAAATCTAC ATCTCTACTT CTGGAAACAT GATTGATTAT
ATGACAGATG CACGAATTGA TGATACCTTA GATAAAATAT GGGATAATAT GAGTCAAGGA
AATTATTTCG CGGCTGCTCA AACCTTTGTT CAGGAAACTC AAGCATTTGT TAATAAAGGG
GTTCCTGGGG GCACTATCG TGTGGACAGC GAAACAGGTA AAATCACTCG TTATAAAGTC
ATTACCCCGC TGGAAATGGT AATTGCTTTT GCTGCTGCGC TGATACTCAG TTTGGTCTTC
TTAGGCATTA ATATTTCTAA ATATCAATTA AAATTTTCAA GTTATCAATA TCCCTTTAGG
GAAAAAACAA CTTTAAACTT AACCTCCCGC ACAGATCAGT TAACCAACTC TTTCATCACT
ACGCGTCGTA TTCCTAAAAA CAATGGCGGC AGTGGCGGAA TGGGCGGTGG TGGTAGCACC
ACCCACTCAA CTGGCGGCGG CACATTCGGT GGCGGCGGTC GAAGT

EF080-4 (SEQ ID NO:304)
AENSIDDGAQ
LLTPDQINQL KQEIQPLEEK TKASVFIVTT NNNTYGDEQE YADHYLLNKV GKDQNAILFL
IDMDLRKIYI STSGNMIDYM TDARIDDTLD KIWDNMSQGN YFAAAQTFVQ ETQAFVNKGV
PGGHYRVDSE TGKITRYKVI TPLEMVIAFA AALILSLVFL GINISKYQLK FSSYQYPFRE
KTTLNLTSRT DQLTNSFITT RRIPKNNGGS GMGGGGSTT HSTGGGTFGG GGRS

EF081-1 (SEQ ID NO:305)

TABLE 1-continued

Nucleotide and Amino Acid Seqeuences of E. faecalis Genes.

```
TGAATGGAAC GAAGCAATCG TAATAAAAAA TCTTCAAAAA AACCACTTAT TCTTGGTGTT
TCTGCCTTGG TTCTAATCGC TGCTGCCGGT GGCGGGTATT ATGCTTATAG TCAATGGCAA
GCCAAACAAG AATTAGCCGA AGCGAAGAAA ACAGCTACTA CATTTTTAAA CGTATTGTCA
AAACAGGAAT TTGATAAGTT ACCGTCCGTT GTTCAAGAAG CTAGCTTAAA GAAAAATGGC
TATGATACTA AATCTGTTGT TGAAAAATAC CAAGCAATTT ATTCAGGGAT TCAAGCAGAA
GGAGTCAAAG CTAGTGATGT TCAAGTCAAA AAGGCGAAAG ACAATCAATA CACATTTACC
TATAAATTAT CCATGAGCAC GCCTTTAGGC GAAATGAAAG ATTTGTCTTA TCAATCAAGT
ATCGCCAAAA AAGGCGATAC CTACCAAATC GCTTGGAAGC CATCTTTAAT TTTTCCAGAT
ATGTCAGGAA ATGATAAAAT TTCGATTCAA GTAGATAATG CCAAACGTGG AGAAATTGTC
GATCGTAATG GTAGTGGGCT AGCAATTAAC AAAGTGTTTG ACGAAGTGGG CGTAGTGCCT
GGCAAACTCG GTTCTGGCGC AGAAAAAACA GCCAATATCA AAGCTTTTAG TGATAAATTC
GGCGTTTCTG TTGATGAAAT CAATCAAAAG TTAAGCCAAG GATGGGTCCA AGCAGACTCC
TTTGTACCAA TCACAGTCGC TTCTGAACCA GTGACAGAAT TACCAACAGG GGCTGCGACA
AAAGATACAG AGTCACGTTA TTATCCGCTG GGGGAAGCAN TGCGCAATTA A

EF081-2 (SEQ ID NO:306)
MERSNRNKKS SKKPLILGVS ALVLIAAAGG GYYAYSQWQA KQELAEAKKT ATTFLNVLSK
QEFDKLPSVV QEASLKKNGY DTKSVVEKYQ AIYSGIQAEG VKASDVQVKK AKDNQYTFTY
KLSMSTPLGE MKDLSYQSSI AKKGDTYQIA WKPSLIFPDM SGNDKISIQV DNAKRGEIVD
RNGSGLAINK VFDEVGVVPG KLGSGAEKTA NIKAFSDKFG VSVDEINQKL SQGWVQADSF
VPITVASEPV TELPTGAATK DTESRYYPLG EAXRN

EF081-3 (SEQ ID NO:307)
T GGCGGGTATT ATGCTTATAG TCAATGGCAA
GCCAAACAAG AATTAGCCGA AGCGAAGAAA ACAGCTACTA CATTTTTAAA CGTATTGTCA
AAACAGGAAT TTGATAAGTT ACCGTCCGTT GTTCAAGAAG CTAGCTTAAA GAAAAATGGC
TATGATACTA AATCTGTTGT TGAAAAATAC CAAGCAATTT ATTCAGGGAT TCAAGCAGAA
GGAGTCAAAG CTAGTGATGT TCAAGTCAAA AAGGCGAAAG ACAATCAATA CACATTTACC
TATAAATTAT CGATGAGCAC GCCTTTAGGC GAAATGAAAG ATTTGTCTTA TCAATCAAGT
ATCGCCAAAA AAGGCGATAC CTACCAAATC GCTTGGAAGC CATCTTTAAT TTTTCCAGAT
ATGTCAGGAA ATGATAAAAT TTCGATTCAA GTAGATAATG CCAAACGTGG AGAAATTGTC
GATCGTAATG GTAGTGGGCT AGCAATTAAC AAAGTGTTTG ACGAAGTGGG CGTAGTGCCT
GGCAAACTCG GTTCTGGCGC AGAAAAAACA GCCAATATCA AAGCTTTTAG TGATAAATTC
GGCGTTTCTG TTGATGAAAT CAATCAAAAC TTAAGCCAAG GATGGGTCCA AGCAGACTCC
TTTGTACCAA TCACAGTCGC TTCTGAACCA GTGACAGAAT TACCAACAGG GGCTGCGACA
AAAGATACAG AGTCACGTTA TTATCCGCTG GGGG

EP081-4 (SEQ ID NO:308)
G GYYAYSQWQA KQELAEAKKT ATTFLNVLSK
QEFDKLPSVV QEASLKKNGY DTKSVVEKYQ AIYSGIQAEG VKASDVQVKK AKDNQYTFTY
KLSMSTPLGE MKDLSYQSSI AKKGDTYQIA WKPSLIFFDM SGNDKISIQY DNAKRGEIVD
RNGSGLAINK VFDEVGVVPG KLGSGAEKTA NIKAFSDKFG VSVDEINQKL SQGWVQADSF
VPITVASEPV TELPTGAATK DTESRYYPLG

EP082-1 (SEQ ID NO:309)
TAAAAAATGA AAAAGATCGT GCGCATTTCA AGCATTTTGT TCGTTGCTAC GCCTCTTATG
CTTTTTAAATA GTTCAAAAGT TGAAGTCGCT CAAGTCGCTT CTATTCAATC CAACGCTGAT
ATTACGTTTG CTCTTGATAA TACTGTCACG CCACCTGTCA ACCCGACGAA CCCTTCTCAG
CCTGTGACAC CTAATCCTGC TGATCCTCAT CAACCTGGTA CAGCCGGACC CCTTAGTATT
GACTATGTTT CAAATATCCA TTTTGGATCA AAACAAATTC AAGCCGGAAC AGCGATCTAT
TCGGCACAAC TGGATCAAGT GCAAAATAGT ACTGGCGATT TAATTAGCGT GCCAAACTAT
GTTCAAGTAA CTGACAAACG TGGTCTAAAT CTTGGCTGGA AATTATCAGT TAAACAGAGT
GCGCAATTTG CTACAAGTGA TTCAACACCC GCTGTTTTGG ATAATGCATC CTTGACCTTT
TTAGCAGCAA CACCCAATTC AACACAGTTA CTTTCTTTGG CGCCATTAAC GGTCCCAGTA
ACCTTGGATC CAACTGGTGC CGCCACTTCT CCTGTGGCGA CTGCCGCTCT TTCAACAGGA
ATGGGCACTT GGACATTAGC TTTTGGTAGC GGANCGACCG CTGCTCAAGG CATTCAATTA
ACTGTTCCTG CCACAACGAA AAAAGTTGCA GCTAAACAAT ATAAAACAAC GCTTACTTGG
ATTTTGGATG ATACACCACT TTAA

EP082-2 (SEQ ID NO:310)
MKKIVRISS ILFVATPLML LNSSKVEAAQ VASIQSNADI TFALDNTVTP PVNPTNPSQF
VTPNPADPHQ PGTAGPLSID YVSNIHFGSK QIQAGTAIYS AQLDQVQNST GDLISVPNYV
QVTDKRGLNL GVKLSVKQSA QFATSDSTPA VLDNASLTFL AATPNSTQLL SLAPLTVPVT
LDPTGAATSP VATAALSTGM GTWTLAFGSG XTAAQGIQLT VPATTKKVAA KQYKTTLTWI
LDDTPL

EP082-3 (SEQ ID NO:311)
AGCT CAAGTCGCTT CTATTCAATC CAACGCTGAT
ATTACGTTTG CTCTTGATAA TACTGTCACG CCACCTGTCA ACCCGACGAA CCCTTCTCAG
CCTGTGACAC CTAATCCTGC TGATCCTCAT CAACCTGGTA CAGCCGGACC CCTTAGTATT
GACTATGTTT CAAATATCCA TTTTGCATCA AAACAAATTC AAGCCGGAAC AGCGATCTAT
TCGGCACAAC TGGATCAAGT GCAAAATAGT ACTGGCGATT TAATTAGCGT GCCAAACTAT
GTTCAACTAA CTGACAAACG TGGTCTAAAT CTTGGCTGGA AATTATCAGT TAAACAGAGT
GCGCAATTTG CTACAAGTGA TTCAACACCC GCTGTTTTGG ATAATGCATC CTTGACCTTT
TTAGCAGCAA CACCCAATTC AACACAGTTA CTTTCTTTGG CGCCATTAAC GGTCCCAGTA
ACCTTGGATC CAACTGGTGC CGCCACTTCT CCTGTGGCGA CTGCCGCTCT TTCAACAGGA
ATGGGCACTT GGACATTAGC TTTTGGTAGC GGANCGACCG CTGCTCAAGG CATTCAATTA
```

TABLE 1-continued

Nucleotide and Amino Acid Seqeuences of E. faecalis Genes.

ACTGTTCCTG CGACAACGAA AAAAGTTGCA GCTAAACAAT ATAAAACAAC GCTTACTTGG
ATTTTGGATG ATACACCACT

EP082-4 (SEQ ID NO:312)
AQ VASIQSNADI TFALDNTVTF PVNPTNPSQP
VTPNPADPHQ PGTAGPLSID YVSNIHFGSK QIQAGTAIYS AQLDQVQNST GDLISVPNYV
QVTDKSGLNL GWKLSVKQSA QFATSDSTPA VLDNASLTFL AATPNSTQLL SLAPLTVPVT
LDPTGAATSP VATAALSTGM GTWTLAFGSG XTAAQGIQLT VPATTKKVAA KQYKTTLTWI
LDDTP

EF083-1 (SEQ ID NO:313)
TAATTTAAAA GACAAGGAGA AATAAAAATG AAAAAGAAAA TTTTAGCAGG AGCGCTTGTC
GCTCTGTTTT TTATGCCTAC AGCTATGTTT GCCGCAAGG GAGACCAAGG TGTGGATTGG
GCGATTTATC AAGGTGAACA AGGTCGCTTT GGCTATGCAC ATGATAAATT CGCTATTGCC
CAGATTGGAG GCTACAATGC TAGCGGTATT TATGAACAAT ACACATATAA AACGCAAGTG
GCAAGTGCTA TTGCCCAAGG TAAACGTGCG CATACCTATA TTTGGTATGA CACTTGGGGA
AACATGGACA TTGCGAAAAC AACAATGGAT TACTTTTTGC CACGTATTCA AACGCCTAAA
AATTCCATCG TTGCATTAGA TTTTGAACAT GGAGCGTTGG CTAGTGTTCC AGATGGATAT
GGAGGATATG TAAGTTCAGA TGCCGAAAAA GCAGCAAATA CAGAGACAAT TTTGTACGGT
ATGCGCAGAA TCAAACAGGC TGGCTATACT CCAATGTATT ACAGCTATAA GCCATTTACA
CTAAATCATG TAAACTATCA ACAAATCATC AAAGAGTTTC CTAACTCTTT ATGGATTGCT
GCGTATCCTA TCGATGGTGT GTCACCATAT CCATTGTATG CTTATTTCCC AAGCATGGAT
GCTATTGGTA TTTGGCAATT CACATCCGCT TATATTGCAG GTGGTTTAGA TGGTAACGTA
GATTTAACAG GAATTACGGA TAGTGGTTAT ACAGATACCA ATAAACCAGA AACGGATACG
CCAGCAACAG ATGCAGGCGA AGAAATTGAA AAAATACCTA ATTCTGATGT TAAAGTTGGC
GATACCGTCA AAGTGAAATT TAATGTAGAT GCTTGGGCAA CTGGGGAAGC TATTCCGCAA
TGGGTAAAAG GAAACAGCTA CAAAGTGCAA GAAGTAACTG GAAGCAGAGT ATTGCTTGAA
GGTATCTTGT CATGGATTAG CAAAGGTGAT ATTGAATTAT TGCCAGACGC AACAGTCGTC
CCTGATAAGC AACCAGAAGC GACTCATGTG CTACAATACG GAGAAACATT ATCAAGTATT
GCTTATCAAT ATGGAACAGA CTATCAAACG TTGGCGGCAT TAAATGGATT GGCTAATCCA
AATCTTATTT ATCCTGGTCA AGTTTTGAAA GTCAATGGAT CGGCAACAAG TAATGTCTAC
ACGGTTAAAT ACGGCGATAA TTTATCTAGT ATTGCAGCAA AACTTGGCAC TACTTATCAA
GCTTTAGCTG CATTAAACGG ATTAGCAAAT CCTAACTTGA TTTATCCAGG TCAAACATTG
AATTATTAA

EF083-2 (SEQ ID NO:314)
MK KKILAGALVA LFFMPTAMFA AKGDQGVDWA IYQGEQGRFG YAHDKFAIAQ
IGGYNASGIY EQYTYKTQVA SAIAQGKRAH TYIWYDTWGN MDIAKTTMDY FLPRIQTPKN
SIVALDFEHG ALASVPDGYG GYVSSDAEKA ANTETILYGM RRIKQAGYTP MYYSYKPFTL
NHVNYQQIIK EFPNSLWIAA YPIDGVSPYP LYAYFPSMDG IGIWQFTSAY IAGGLDGNVD
LTGITDSGYT DTNKPETDTP ATDAGEEIEK IPNSDVKVGD TVKVKFNVDA WATGEAIPQW
VKGNSYKVQE VTGSRVLLEG ILSWISKGDI ELLPDATVVP DKQPEATHVV QYGETLSSIA
YQYGTDYQTL AALNGLANPN LIYPGQVLKV NGSATSNVYT VKYGDNLSSI AAKLGTTYQA
LAALNGLANP NLIYPGQTLN Y

EF083-3 (SEQ ID NO:315)
AAAAG GAGCCAAGG TGTGGATTGG
GCGATTTATC AAGGTGAACA AGGTCGCTTT GGCTATGCAC ATGATAAATT CGCTATTGCC
CAGATTGGAG GCTACAATGC TAGCGGTATT TATGAACAAT ACACATATAA AACGCAAGTG
GCAAGTGCTA TTGCCCAAGG TAAACGTGCG CATACCTATA TTTGGTATGA CACTTGGGGA
AACATGGACA TTGCGAAAAC AACAATGGAT TACTTTTTGC CACGTATTCA AACGCCTAAA
AATTCCATCG TTGCATTAGA TTTTGAACAT GGAGCGTTGG CTAGTGTTCC AGATGGATAT
GGAGGATATG TAAGTTCAGA TGCCGAAAAA GCAGCAAATA CAGAGACAAT TTTGTACGGT
ATGCGCAGAA TCAAACAGGC TGGCTATACT CCAATGTATT ACAGCTATAA GCCATTTACA
CTAAATCATG TAAACTATCA ACAAATCATC AAAGAGTTTC CTAACTCTTT ATGGATTGCT
GCGTATCCTA TCGATGGTGT GTCACCATAT CCATTGTATG CTTATTTCCC AAGCATGGAT
GGTATTGGTA TTTGGCAATT CACATCCGCT TATATTGCAG GTGGTTTAGA TGGTAACGTA
GATTTAACAT GAATTACGGA TAGTGGTTAT ACAGATACCA ATAAACCAGA AACGGATACG
CCAGCAACAG ATGCAGGCGA AGAAATTGAA AAAATACCTA ATTCTGATGT TAAAGTTGGC
GATACCGTCA AAGTGAAATT TAATGTAGAT GCTTGGGCAA ATGGGGAAGC TATTCCGCAA
TGGGTAAAAG GAAACAGCTA CAAAGTGCAA GAAGTAACTG GAAGCAGAGT ATTGCTTGAA
GGTATCAAGT CATGGATTAG CAAAGGTGAT ATTGAATTAT TGCCAGACGC AACAGTCGTC
CCTGATAAGC AACCAGAAGC GACTCATGTG CTACAATACG GAGAAACATT ATCAAGTATT
GCTTATCAAT ATGGAACAGA CTATCAAACG TTGGCGGCAT TAAATGGATT GGCTAATCCA
AATCTTATTT ATCCTGGTCA AGTTTTGAAA GTCAATGGAT CGGCAACAAG TAATGTCTAC
ACGGTTAAAT ACGGCGATAA TTTATCTAGT ATTGCAGCAA AACTTGGCAC TACTTATCAA
GCTTTAGCTG CATTAAACGG ATTAGCAAAT CCTAACTTGA TTTATCCAGG TCAAACATTG
AAT

EF083-4 (SEQ ID NO:316)
KGDQGVDWA IYQGEQGRFG YAHDKFAIAQ
IGGYNASGIY EQYTYKTQVA SAIAQGKRAH TYIWYDTWGN MDIAKTTMDY FLPRIQTPKN
SIVALDFEHG ALASVPDGYG GYVSSDAEKA ANTETILYGM RRIKQAGYTP MYYSYKPFTL
NHVNYQQIIK EFPNSLWIAA YPIDGVSPYP LYAYFPSMDG IGIWQFTSAY IAGGLDGNVD
LTGITDSGYT DTNKPETDTP ATDAGEEIEK IPNSDVKVGD TVKVKFNVDA WATGEAIPQW
VKGNSYKVQE VTGSRVLLEG ILSWISKGDI ELLPDATVVP DKQPEATHVV QYGETLSSIA
YQYGTDYQTL AALNGLANPN LIYPGQVLKV NGSATSNVYT VKYGDNLSSI AAKLGTTYQA

TABLE 1-continued

Nucleotide and Amino Acid Seqeuences of E. faecalis Genes.

LAALNGLANP NLIYPGQTLN

EF084-1 (SEQ ID NO:317)
TAGTCAAACG TTTATTTTTT CCTTAAATCC AGAAAAAATC CCGTAATTAT GGTACACTAC
CTATTGAATT GGAGGAGAAC TATGAAGAAA TTTGATGTAA TTATTGTCGG TGCTGGGACG
AGCGGTATGA TGGCCACGAT TGCGGCCGCC GAAGCAGGCG CTCAAGTATT ATTGATTGAA
AAAAATCGCC GTGTTGGGAA AAAATTATTA ATGACTGGTG GCGGCCGCTG TAATGTAACC
AATAATCGGC CCGCAGAAGA AATCATTTCA TTTATTCCTG GAATGGAAA ATTTTTATAC
AGCGCATTTT CACAATTTGT TAACTATGAT ATCATGAACT TTTTTGAATC CAATGGTATT
CACTTAAAAG AAGAAGATCA CGGACGCATG TTCCCTGTTA CAGATAAATC GAAGTCAATT
GTTGATGCGC TATTTAACCG CATTAACGAA TTAGGAGTCA CTGTTTTTAC AAAAACACAG
GTCACAAAAT TACTACGAAA AGACGATCAA ATAATTGGCG TTGAAACCGA ACTGGAAAAA
ATTTATGCAC CGTGTGTTGT ATTAACAACT GGCGGCCGCA CTTATCCTTA CACAGGAGCA
ACTGGTGATG GCTATAAACT AGCCAAAAAA ATGGGGCATA CCATCAGCCC GCTCTACCCT
ACCGAATCAC CTATTATTTC TGAAGAACCT TTTATCCTGG ATAAAACGTT GCAAGGTCTC
TCTTTACAAG ATGTTAATTT AACTGTTTTG AACCAAAAAG GAAAACCTTT AGTTAATCAT
CAAATGGATA TGCTGTTTAC ACATTTTGGC ATTTCAGGAC CTGCCGCGCT CCGCTGTTCT
AGTTTTATTA ACCAAGAATT AACTCGCAAC GGTAATCAAC CTGTCACGGT AGCCTTGGAT
GTGTTTCCGA CAAAATCTTT TGAAGAAGTG CCTGCCAAAC AACTAACAGA AAAGCAACGN
CTTTCCTTTG TGGAACTACT GAAAGACTTT CAGTTCACTG TTACGAAAAC ATTGCCAAAG
GAAAAATCTT TTGTCACAGG CGGTGGGATT TCCCTCAAAG AAGTGACCCC TAAAACAATG
GAGAGCAAAT TAGTCAATGG TTTATTTTTT GCTGGTGAAC TTTTAGATAT TAATGGCTAT
ACTGGAGGCT ACAATGTTAC AGCTGCATTT GTCACTGGAC ATGTTGCTGG CTCCCATGCC
GCAGAAATTG CAGAATACAC CTATTTACCA ATTGAAGAAG TCTAA

EF084-2 (SEQ ID NO:318)
MKKF DVIIVGAGTS GMMATIAAAE AGAQVLLIEK
NRRVGKKLLM TGGGRCNVTN NRPAEEIISF IPGNGKFLYS AFSQFDNYDI MNFFESNGIH
LKEEDHGRMF PVTDKSKSIV DALFNRINEL GVTVFTKTQV TKLLRKDDQI IGVETELEKI
YAPCVVLTTG GRTYPSTGAT GDGYKLAKKM GHTISPLYPT ESPIISEEPF ILDKTLQGLS
LQDVNLTVLN QKGKPLVNHQ MDMLFTHFGI SGPAALRCSS FINQELTRNG NQPVTVALDV
FPTKSFEEVP AKQLTEKQRL SFVELLKDFQ FTVTKTLPLE KSFVTGGGIS LKEVTPKTME
SKLVNGLFFA GELLDINGYT GGYNVTAAFV TGHVAGSHAA EIAEYTYLPI EEV

EF084-3 (SEQ ID NO:319)
C GAAGCAGGCG CTCAAGTATT ATTGATTGAA
AAAAATCGCC GTGTTGGGAA AAAATTATTA ATGACTGGTG GCGGCCGCTG TAATGTAACC
AATAATCGGC CCGCAGAAGA AATCATTTCA TTTATTCCTG GAATGGAAA ATTTTTAAC
AGCGCATTTT CACAATTTGA TAACTATGAT ATCATGAACT TTTTTGAATC CAATGGTATT
CACTTAAAAG AAGAAGATCA CGGACGCATG TTCCCTGTTA CAGATAAATC GAAGTCAATT
GTTGATGCGC TATTTAACCG CATTAACGAA TTAGGAGTCA CTGTTTTTAC AAAAACACAG
GTCACAAAAT TACTACGAAA AGACGATCAA ATAATTGGCG TTGAAACCGA ACTGGAAAAA
ATTTATGCAC CGTGTGTTGT ATTAACAACT GGCGGCCGCA CTTATCCTTC CACAGGAGCA
ACTGGTGATG GCTATAAACT AGCCAAAAAA ATGGGGCATA CCATCAGCCC GCTCTACCCT
ACCGAATCAC CTATTATTTC TGAAGAACCT TTTATCCTGG ATAAAACGTT GCAAGGTCTC
TCTTTACAAG ATGTTAATTT AACTGTTTTG AACCAAAAAG GAAAACCTTT AGTTAATCAT
CAAATGGATA TGCTGTTTAC ACATTTTGGC ATTTCAGGAC CTGCCGCGCT CCGCTGTTCT
AGTTTTATTA ACCAAGAATT AACTCGCAAC GGTAATCAAC CTGTCACGGT AGCCTTGGAT
GTGTTTCCGA CAAAATCTTT TGAAGAAGTG CCTGCCAAAC AACTAACAGA AAAGCAACGN
CTTTCCTTTG TGGAACTACT GAAAGACTTT CAGTTCACTG TTACGAAAAC ATTGCCTTTG
GAAAAATCTT TTGTCACAGG CGGTGGGATT TCCCTCAAAG AAGTGACCCC TAAAACAATG
GAGAGCAAAT TAGTCAATGG TTTATTTTTT GCTGGTGAAC TTTTAGATAT TAATGGCTAT
ACTGGAGGCT ACAATGTTAC AGCTGCATTT GTCACTGGAC ATGTTGCTGG CTCCCATGCC
GCAGAAATTG CAGAATACAC CTATTTACCA ATTGAAGAAG TC

EF084-4 (SEQ ID NO:320)
E AGAQVLLIEK
NRRVGKKLLM TGGGRCNVTN NRPAEEIISF IPGNGKFLYS AFSQFDNYDI MNFFESNGIH
LKEEDHGRMF PVTDKSKSIV DALFNRINEL GVTVFTKTQV TKLLRKDDQI IGVETELEKI
YAPCVVLTTG GRTYPSTGAT GDGYKLAKKM GHTISPLYPT ESPIISEEPF ILDKTLQGLS
LQDVNLTVLN QKGKPLVNHQ MDMLFTHFGI SGPAALRCSS FINQELTRNG NQPVTVALDV
FPTKSFEEVP AKQLTEKQRL SFVELLKDFQ FTVTKTLPLE KSFVTGGGIS LKEVTPKTME
SKLVNGLFFA GELLDINGYT GGYNVTAAFV TGHVAGSHAA EIAEYTYLPI EEV

EF085-1 (SEQ ID NO:321)
TAACCCATGA AATCATTTTG TCCCGCATAT GGGGATATGA CTTTGACGGT GATGGCAGCA
CAGTCCACAC TCATATCAAA AATCTGAGGG CGAACCTGCC GAAAATATCA TCAAAACCAT
CCGCGGTGTA GGTTACCGAT TGGAGGAATC ATTATAATGG AAAGAAAAGG GATTTTCATT
AAGGTTTTTT CCTATACGAT CATTGTCCTG TTACTGCTTG TCGGTGTAAC GGCAACACTG
TTTGCACAGC AATTTGTGTC TTATTTCAGA GCGATGGAAG CACAGCAAAC AGTAAAATCC
TATCAGCCAT TGGTGGAACT GATTCAGAAT AGCGATAGGC TTGATATGCA AGAGGTGGCA
GGGCTGTTTC ACTACAATAA CCAATCCTTT GAGTTTTATA TTGAAGATAA AGAGGGAAGC
GTACTCTATG CCACACCGAA TGCCGATACA TCAAATAGTG TTAGGCCCGA CTTTCTTTAT
GTGGTACATA GAGATGATAA TATTTCGATT GTTGCTCAAA GCAAGGCAGG TGTGGGATTG
CTTTATCAAG GGCTGACAAT TCGGGGAATT GTTATGATTG CGATAATGGT TGTATTCAGC
CTTTTATGCG CGTATATCTT TGCGCGGCAA ATGACAACGC CGATCAAAGC CTTAGCGGAC
AGTGCGAATA AAATGGCAAA CCTGAAAGAA GTACCGCCGC CGCTGGAGCG AAAGGATGAG

TABLE 1-continued

Nucleotide and Amino Acid Seqeuences of *E. faecalis* Genes.

```
CTTGGCGCAC TGGCTCACGA CATGCATTCC ATGTATATCA GGCTGAAAGA AACCATCGCA
AGGCTGGAGG ATGAAATCGC AAGGGAACAT GAGTTGGAGG AAACACAGCG ATATTTCTTT
GCGGCAGCCT CTCATGAGTT AAAAACGCCC ATCGCGGCTG TAAGCGTTCT GTTGGAGGGA
ATGCTTGAAA ATATCGGTGA CTACAAAGAC CATTCTAAGT ATCTGCGCGA ATGCATCAAA
ATGATGGACA GGCAGGGCAA AACCATTTCC GAAATACTGG AGCTTGTCAG CCTGAACGAT
GGGAGAATCG TACCCATAGC CGAACCGCTG GACATAGGGC GCACGGTTGC CGAGCTGCTA
CCCGATTTTC AAACCTTGGC AGAGGCAAAC AACCAGCGGT TCGTCACAGA TATTCCAGCC
GGACAAATTG TCCTGTCCGA TCCGAAGCTG ATCCAAAAGG CGCTATCCAA TGTCATATTG
AATGCGGTTC AGAACACGCC CCAGGGAGGT GAGGTACGGA TATGGAGTGA GCCTGGGGCT
GAAAAATACC GTCTTTCCGT TTTGAACATG GGCGTTCACA TTGATGATAC TGCACTTTCA
AAGCTGTTCA TCCCATTCTA TCGCATTGAT CAGGCGCGAA GCAGCAAAAA GTGGGCGAAG
CGGTTTGGGG CTTGCCATCG TACAAAAAAC GCTGGATGCC ATGAGCCTCC AATATGCGCT
GGAAAACACC TCAGATGGCG TTTTGTTCTG GCTGGATTTA CCGCCCACAT CAACACTATA
AATATTTAA

EF085-2 (SEQ ID NO:322)
MERKGIFIK
VFSYTIIVLL LLVGVTATLF AQQFVSYFRA MEAQQTVKSY QPLVELIQNS DRLDMQEVAG
LFHYNNQSFE FYIEDKEGSV LYATPNADTS NSVRPDFLYV VHRDDNISIV AQSKAGVGLL
YQGLTIRGIV MIAIMVVFSL LCAYIFARQM TTPIKALADS ANKMANLKEV PPPLERKDEL
GALAHDMHSM YIRLKETIAR LEDEIAREHE LEETQRYFFA AASHELKTPI AAVSVLLEGM
LENIGDYKDH SKYLRECIKM MDRQGKTISE ILELVSLNDG RIVPIAEPLD IGRTVAELLP
DFQTLAEANN QRFVTDIPAG QIVLSDPKLI QKALSNVILN AVQNTPQGGE VRIWSEPGAE
KYRLSVLNMG VHIDDTALSK LFIPFYRIDQ ARSSKKWAKR FGACHRTKNA GCHEPPICAG
KHLRWRFVLA GFTAHINTIN I

EF085-3 (SEQ ID NO:323)
GC ATTTGTGTC TTATTTCAGA GCGATGGAAG CACAGCAAAC AGTAAAATCC
TATCAGCCAT TGGTGGAACT GATTCAGAAT AGCGATAGGC TTGATATGCA AGAGGTGGCA
GGGCTGTTTC ACTACAATAA CCAATCCTTT GAGTTTTATA TTGAAGATAA AGAGGGAAGC
GTACTCTATG CCACACCGAA TGCCGATACA TCAAATAGTG TTAGGCCCGA CTTTCTTTAT
GTGGTACATA GAGATGATAA TATTTCGATT GTTGCTCAAA GCAAGGCAGG TGTGGGATTG
CTTTATCAAG GGCTGACAAT TCGGGGAATT GTTATGATTG CGATAATGGT TGTATTCAGA
CTTTTATGCG CGTATATCTT TGCGCGGCAA ATGACAACGC CGATCAAAGC CTTAGCGGAC
AGTGCGAATA AAATGGCAAA CCTGAAAGAA GTACCGCCGC CGCTGGAGCG AAAGGATGAG
CTTGGCGCAC TGGCTCACGA CATGCATTCC ATGTATATCA GGCTGAAACA AACCATCGCA
AGGCTGGAGG ATGAAATCGC AAGGGAACAT GAGTTGGAGG AAACACAGCG ATATTTCTTT
GCGGCAGCCT CTCATGAGTT AAAAACGCCC ATCGCGGCTG TAAGCGTTCT GTTGGAGGGA
ATGCTTGAAA ATATCGGTGA CTACAAAGAC CATTCTAAGT ATCTGCGCGA ATGCATCAAA
ATGATGGACA GGCAGGGCAA AACCATTTCC GAAATACTGG AGCTTGTCAG CCTGAACGAT
GGGAGAATCG TACCCATAGC CGAACCGCTG GACATAGGGC GCACGGTTGC CGAGCTGCTA
CCCGATTTTC AAACCTTGGC AGAGGCAAAC AACCAGCGGT TCGTCACAGA TATTCCAGCC
GGACAAATTG TCCTGTCCGA TCCGAAGCTG ATCCAAAAGG CGCTATCCAA TGTCATATTG
AATGCGGTTC AGAACACGCC CCAGGGAGGT GAGGTACGGA TATGGAGTGA GCCTGGGGCT
GAAAAATACC GTCTTTCCGT TTTGAACATG GGCGTTCACA TTGATGATAC TGCACTTTCA
AAGCTGTTCA TCCCATTCTA TCGCATTGAT CAGGCGCGAA GCAGCAAAAA GTGGGCGAAG
CGGTTTGGGG CTTGCCATCG TACAAAAAAC GCTGGATGCC ATGAGCCACC AATATGCGCT
GGAAAACACC TCAGATGGCG TTTTGTTCTG GCTGGATTTA CCGCCCACAT CAACACTATA
AATATTT

EF085-4 (SEQ ID NO:324)
QFVSYFRA MEAQQTVKSY QPLVELIQNS DRLDMQEVAG
LFHYNNQSFE FYIEDKEGSV LYATPNADTS NSVRPDFLYV VHRDDNISIV AQSKAGVGLL
YQGLTIRGIV MIAIMVVFSL LCAYIFARQM TTPIKALADS ANKMANLKEV PPPLERKDEL
GALAHDMHSM YIRLKETIAR LEDEIAREHE LEETQRYFFA AASHELKTPI AAVSVLLEGM
LENIGDYKDH SKYLRECIKM MDRQGKTISE ILELVSLNDG RIVPIAEPLD IGRTVAELLP
DFQTLAEANN QRFVTDIPAG QIVLSDPKLI QKALSNVILN AVQNTPQGGE VRIWSEPGAE
KYRLSVLNMG VHIDDTALSK LFIPFYRIDQ ARSSKKWAKR FGACHRTKNA GCHEPPICAG
KHLRWRFVLA GFTAHINTIN I

EF086-1 (SEQ ID NO:325)
TAACTGGTGG GATTGGCAAA TTGGTTCCGC GCAGCGCTAA CAGATACATT GATTTTATTA
CATGATGACC TATTGAATAC AGATGCAGAA AAATTAAATA AATTTACTGC TCCGCTGATG
CTGTATGCAA AAGATCCAAA CATACAATGG CCAATTTATC GTGCAACAGG AGCTAACTTA
ACAGATATTT CAATCACCGT TTTAGGTACT GGACTTTTGT TAGAAGATAA TCAACGCCTA
GTACAAGTAC AAGAAGCTGT TCCGTCCGTT TTAAAAAGTG TTTCCTCTGG TGATGGCAAT
TATCCTGATG GTTCCTTGAT TCAACATGGT TATTTTCCGT ACAACGGCAG TTACGGGAAT
GAGTTGCTAA AAGGGTTTGG ACGAATTCAG ACTATTTTAC AAGGTTCCGA CTGGGAGATG
AATGACCCTA ACATTAGTAA TTTATTTAAT GTTGTGGATA AAGGTTACTT ACAATTGATG
GTAAATGGAA AAATGCCATC GATGGTTTCT GGTAGAAGTA TTTCCAGAGC GCCAGAAACG
AATCCTTTTA CTACAGAGTT TGAATCGGGT AAAGAAACAA TAGCTAATTT AACCTTAATT
GCAAAATTTG CACCAGAAAA TTTAAGAAAT CACATTTATA CATCTATCCA AACGTGGCTT
CAACAAAGTG GGTCATACTA TCATTTCTTT AAAAAACCAA GAGATTTTGA AGCGTTAATT
GACTTGAAAA ATGTAGTGAA TAGTGCGTCA CCTGCCCAAG CGACACCAAT GCAATCTTTA
AATGTATATG GTTCGATGGA ACGAGTCCTA CAGAAAAATA ACGAATATGC GGTGGGGATC
AGTATGTATT CACAACGTGT CGGAACTAT GAATTTGGGA ATACGAAAA TAAAAAGGC
TGGCATACAG CAGACGGCAT GCTTTATTTA TACAATCAAG ACTTTGCTCA GTTTGATGAA
```

TABLE 1-continued

Nucleotide and Amino Acid Seqeuences of E. faecalis Genes.

```
GGATACTGGG CAACGATCGA TCCATATCGA TTGCCAGGAA CGACAGTTGA CACAAGAGAA
TTGGCAAATG GTGCTTATAC AGGGAAACGC AGTCCCCAGT CATGGGTAGG TGGCTCAAAT
AATGGACAGG TTGCCTCTAT AGGAATGTTT TTAGATAAAA GTAATGAAGG AATGAACTTA
GTTGCTAAAA AATCTTGGTT CTTATTAGAT GGTCAAATCA TTAATTTGGG AAGTGGCATT
ACTGGTACGA CAGATGCTTC GATTGAAACA ATCCTCGATA ATCGGATGAT TCATCCACAG
GAAGTGAAGC TTAACCAAGG TTCAGACAAA GATAATTCTT GGATTAGTTT AAGCGCAGCG
ANTCCATTGA ATAACATTGG CTATGTTTTT CCTAATTCNA TGAATACGCT TGATGTTCAA
ATAGAAGAAC GCTCTGGTCG CTACGGAGAT ATTAACGAAT ACTTTGTTAA TGATAAAACC
TATACAAATA CATTTGCTAA AATTAGTAAA AATTATGGCA AGACTGTTGA AAATGGTACT
TACGAATATT TAACAGTGGT TGGGAAAACG AATGAAGAAA TCGCAGCTCT TTCTAAAAAC
AAAGGCTATA CTGTTCTAGA AAATACAGCA AACTTACAAG CCATTGAAGC AGGTAATTAT
GTCATGATGA ATACATGGAA TAATGACCAA GAAATTGCAG GACTGTATGC GTATGATCCA
ATGTCGGTTA TTTCAGAAAA AATTGATAAC GGTGTTTATC GCTTAACTCT TGCGAATCCT
TTACAAAATA ATGCATCCGT TTCTATTGAA TTTGATAAGG GCATTCTTGA AGTAGTCGCA
GCGGACCCAG AAATTTCTGT TGACCAAAAT ATTATCACTT TAAATAGTGC GGGGTTAAAT
GGCAGCTCGC GTTCAATCAT TGTTAAAACA ACTCCTGAAG TAACGAAAGA AGCGTTAGAA
AAATTAATTC AGGAACAAAA AGAACACCAA GAAAAAGACT ACACCGCAAG CAGCTGGAAA
GTCTACAGCG AAGCATTGAA ACAAGCACAA ACTGTGGCAG ATCAAACAAC AGCAACGCAA
GCAGAAGTAG ACCAAGCAGA AACAGAGTTA CGTTCGGCAG TGAAGCAATT GGTAAAAGTG
CCAACTAAAG AAGTAGATAA AACCAACTTG TTGAAAATCA TCAAAGAAAA CGAGAAACAC
CAAGAAAAAG ACTACACCGC AAGCAGTTGG AAAGTCTACA GTGAAGCATT GAAGCAAGCG
CAAACTGTGG CAGATCAAAC AACAGCAACG CAAGCAGAAG TAGACCAAGC AGAAGCAAAA
CTACGTTCGG CAGTGAAGCG ATTAACATTG AAAAATAGTG GGGAAAATAA AAAGGAGCAA
AAAAATGGGG GAATAATGG ACACTTAAAT ACTAGTACAG GAGTTGATCA AACTGGTACG
AAACAAGTTA AGCCATCAAG CCAAGGTGGT TTCAGAAAAG CTAGCCAATT TTTACCGAGC
ACAGGAGAAA AGAAATCGAT CGCGCTTGTG ATTATTGGTC TTCTAGTTAT CGCCACTGGG
TGTCTTTTAG TTTTTCGTAA AAGTAAATCG AAGAAGTAA

EF086-2 (SEQ ID NO:326)
LVGLANWFRA ALTDTLILLH DDLLNTDAEK LNKFTAPLML YAKDPNIQWP IYRATGANLT
DISITVLGTG LLLEDNQRLV QVQEAVPSVL KSVSSGDGLY PDGSLIQHGY FPYNGSYGNE
LLKGFGRIQT ILQGSDWEMN DPNISNLFNV VDKGYLQLMV NGKMPSMVSG RSISRAPETN
PFTTEFESGK ETIANLTLIA KFAPENLRND IYTSIQTWLQ QSGSYYHFFK KPRDFEALID
LKNVVNSASP AQATPMQSLN VYGSMDRVLQ KNNEYAVGIS MYSQRVGNYE FGNTENKKGW
HTADGMLYLY NQDFAQFDEG YWATIDPYRL PGTTVDTREL ANGAYTGKRS PQSWVGGSNN
GQVASIGMFL DKSNEGMNLV AKKSWFLLDG QIINLGSGIT GTTDASIETI LDNRMIHPQE
VKLNQGSDKD NSWISLSAAX PLNNIGYVFP NSMNTLDVQI EERSGRYGDI NEYFVNDKTY
TNTFAKISKN YGKTVENGTY EYLTVVGKTN EEIAALSKNK GYTVLENTAN LQAIEAGNYV
MMNTWNNDQE IAGLYAYDPM SVISEKIDNG VYRLTLANPL QNNASVSIEF DKGILEVVAA
DPEISVDQNI ITLNSAGLNG SSRSIIVKTT PEVTKEALEK LIQEQKEHQE KDYTASSWKV
YSEALKQAQT VADQTTATQA EVDQAETELR SAVKQLVKVP TKEVDKTNLL KIIKENEKHQ
EKDYTASSWK VYSEALKQAQ TVADQTTATQ AEVDQAEAKL RSAVKRLTLK NSGENKKEQK
NGGNNGHLNT STGVDQTGTK QVKPSSQGGF RKASQFLPST GEKKSIALVI IGLLVIASGC
LLVFRKSKSK K

EF086-3 (SEQ ID NO:327)
ACCAGAAAA TTTAAGAAAT GACATTTATA CATCTATCCA AACGTGGCTT
CAACAAAGTG GGTCATACTA TCATTTCTTT AAAAAACCAA GAGATTTTGA AGCGTTAATT
GACTTGAAAA ATGTAGTGAA TAGTGCGTCA CCTGCCCAAG CGACACCAAT GCAATCTTTA
AATGTATATG GTTCGATGGA TCGAGTCCTA CAGAAAAATA ACGAATATGC GGTGGGGATC
AGTATGTATT CACAACGTGT CGGAAACTAT GAATTTGGGA ATACGGAAAA TAAAAAAGGC
TGGCATACAG CAGACGGCAT GCTTTATTTA TACAATGAAG ACTTTGCTCA GTTTGATGAA
GGATACTGGG CAACGATCGA TCCATATCGA TTACCAGGAA CGACAGTTGA CACAAGAGAA
TTGGCAAATG GTGCTTATAC AGGGAAACGC AGTCCCCAGT CATGGGTAGG TGGCTCAAAT
AAT

EF086-4 (SEQ ID NO:328)
PENLRND IYTSIQTWLQ QSGSYYHFFK KPRDFEALID
LKNVVNSASP AQATPMQSLN VYGSMDRVLQ KNNEYAVGIS MYSQRVGNYE FGNTENKKGW
HTADGMLYLY NQDFAQFDEG YWATIDPYRL PGTTVDTREL ANGAYTGKRS PQSWVGGSNN

EF087-1 (SEQ ID NO:329)
TAACTGGTGG GATTGGCAAA TTGGTTCCGC GCAGCGCTAA CAGATACATT GATTTTATTA
CATGATGACC TATTGAATAC AGATGCGAAA AAATTAAATA AATTTACTGC TCCGCTGATG
CTGTATGCAA AAGATCCAAA CATACAATGG CCAATTTATC GTGCAACAGG AGCTAACTTA
ACAGATATTT CAATCACCGT TTTAGGTACT GGACTTTTGT TAGAAGATAA TCAACGCCTA
GTACAAGTAC AAGAAGCTGT TCCGTCCGTT TTAAAAAGTG TTTCCTCTGG TGATGGCTTA
TATCCTGATG GTTCCTTGAT TCAACATGGT TATTTTCCGT ACAACGGCAG TTACGGGAAT
GAGTTGCTAA AAGGGTTTGG ACGAATTCAG ACTATTTTAC AAGGTTCCGA CTGGGAGATG
AATGACCCTA ACATTAGTAA TTTATTTAAT GTTGTGGATA AAGGTTACTT ACAATTGATG
GTAAATGGAA AAATGCCATC GATGGTTTCT GGTAGAAGTA TTTCCAGAGC GCCAGAAACG
AATCCTTTTA CTACAGAGTT TGAATCGGGT AAAGAAACAA TAGCTAATTT AACCTTAATT
GCAAAATTTG CACCAGAAAA TTTAAGAAAT GACATTTATA CATCTATCCA AACGTGGCTT
CAACAAAGTG GGTCATACTA TCATTTCTTT AAAAAACCAA GAGATTTTGA AGCGTTAATT
GACTTGAAAA ATGTAGTGAA TAGAGCGACA CCTGCCCAAG CGACACCAAT GCAATCTTTA
AATGTATATG GTTCGATGGA TCGAGTCCTA CAGAAAAATA ACGAATATGC GGTGGGGATC
AGTATGTATT CACAACGTGT CGGAAACTAT GAATTTGGGA ATACGGAAAA TAAAAAAGGC
```

TABLE 1-continued

Nucleotide and Amino Acid Seqeuences of E. faecalis Genes.

```
TGGCATACAG CAGACGGCAT GCTTTATTTA TACAATCAAG ACTTTGCTCA GTTTGATGAA
GGATACTGGG CAACGATCGA TCCATATCGA TTACCAGGAA CGACAGTTGA CACAAGAGAA
TTGGCAAATG GTGCTTATAC AGGGAAACGC AGTCCCCAGT CATGGGTAGG TGGCTCAAAT
AATGGACAGG TTGCCTCTAT AGGAATGTTT TTAGATAAAA GTAATGAAGG AATGAACTTA
GTTGCTAAAA AATCTTGGTT CTTATTAGAT GGTCAAATCA TTAATTTGGG AAGTGGCATT
ACTGGTACGA CAGATGCTTC GATTGAAACA ATCCTCGATA ATCGGATGAT TCATCCACAG
GAAGTGAAGC TTAACCAAGG TTCAGACAAA GATAATTCTT GGATTAGTTT AAGCGCAGCG
ANTCCATTGA ATAACATTGG CTATGTTTTT CCTAATTCNA TGAATACGCT TGATGTTCAA
ATAGAAGAAC GCTCTGGTCG CTACGGAGAT ATTAACGAAT ACTTTGTTAA TGATAAAACC
TATACAAATA CATTTGCTAA AATTAGTAAA AATTATGGCA AGACTGTTGA AAATGGTACT
TACGAATATT TAACAGTGGT TGGGAAAACG AATGAAGAAA TCGCAGCTCT TTCTAAAAAC
AAAGGCTATA CTGTTCTAGA AAATACAGCA AACTTACAAG CCATTGAAGC AGGTAATTAT
GTCATGATGA ATACATGGAA TAATGACCAA GAAATTGCAG GACTGTATGC GTATGATCCA
ATGTCGGTTA TTTCAGAAAA AATTGATAAC GGTGTTTATC GCTTAACTCT TGCGAATCCT
TTACAAAATA ATGCATCCGT TTCTATTGAA TTTGATAAGG GCATTCTTGA AGTAGTCGCA
GCGGACCCAG AAATTTCTGT TGACCAAAAT ATTATCACTT TAAATAGTGC GGGGTTAAAT
GGCAGCTCGC GTTCAATCAT TGTTAAAACA ACTCCTGAAG TAACGAAAGA AGCGTTAGAA
AAATTAATTC AGGAACAAAA AGAACACCAA GAAAAAGACT ACACCGCAAG CAGCTGGAAA
GTCTACAGCG AAGCATTGAA ACAAGCACAA ACTGTGGCAG ATCAAACAAC AGCAACGCAA
GCAGAAGTAG ACCAAGCAGA AACAGAGTTA CGTTCGGCAG TGAAGCAATT GGTAAAAGTG
CCAACTAAAG AAGTAGATAA AACCAACTTG TTGAAAATCA TCAAAGAAAA CGAGAAACAC
CAAGAAAAAG ACTACACCGC AAGCAGTTGG AAAGTCTACA GTGAAGCATT GAAGCAAGCG
CAAACTGTGG CAGATCAAAC AACAGCAACG CAAGCAGAAG TAGACCAAGC AGAAGCAAAA
CTACGTTCGG CAGTGAAGCG ATTAACATTG AAAAATAGTG GGGAAAATAA AAAGGAGCAA
AAAAATGGGG GGAATAATGG ACACTTAAAT ACTAGTACAG GAGTTGATCA AACTGGTACG
AAACAAGTTA AGCCATCAAG CCAAGGTGGT TTCAGAAAAG CTAGCCAATT TTTACCGAGC
ACAGGAGAAA AGAAATCGAT CGCGCTTGTG ATTATTGGTC TTCTAGTTAT CGCCAGTGGG
TGTCTTTTAG TTTTTCGTAA AAGTAAATCG AAGAAGTAA
```

EF087-2 (SEQ ID NO:330)
LVGLANWFRA ALTDTLILLH DDLLNTDAEK LNKFTAPLML YAKDPNIQWP IYRATGANLT
DISITVLGTG LLLEDNQRLV QVQEAVPSVL KSVSSGDGLY PDGSLIQHGY FPYNGSYGNE
LLKGFGRIQT ILQGSDWEMN DPNISNLFNV VDKGYLQLMV NGKMPSMVSG RSISPARETN
PFTTEFESGK ETIANLTLIA KFAPENLRND IYTSIQTWLQ QSGSYYHFFK KPRDFEALID
LKNVVNSASP AQATPMQSLN VYGSMDRVLQ KNNEYAVGIS MYSQRVGNYE FGNTENKKGW
HTADGMLYLY NQDFAQFDEG YWATIDPYRL PGTTVDTREL ANGAYTGKRS PQSWVGGSNN
GQVASIGMFL DKSNEGMNLV AKKSWFLLDG QIINLGSGIT GTTDASIETI LDNRMIHPQE
VKLNQGSDKD NSWISLSAAX PLNNIGYVFP NSMNTLDVQI EERSGRYGDI NEYFVNDKTY
TNTFAKISKN YGKTVENGTY EYLTVVGKTN EEIAALSKNK GYTVLENTAN LQAIEAGNYV
MMNTWNNDQE IAGLYAYDPM SVISEKIDNG VYRLTLANPL QNNASVSIEF DKGILEVVAA
DPEISVDQNI ITLNSAGLNG SSRSIIVKTT PEVTKEALEK LIQEQKEHQE KDYTASSWKV
YSEALKQAQT VADQTTATQA EVDQAETELR SAVKQLVKVP TKEVDKTNLL KIIKENEKHQ
EKDYTASSWK VYSEALKQAQ TVADQTTATQ AEVDQAEAKL RSAVKRLTLK NSGENKKEQK
NGGNNGHLNT STGVDQTGTK QVKPSSQGGF RKASQFLPST GEKKSIALVI IGLLVIASGC
LLVFRKSKSK K

EF087-3 (SEQ ID NO:331)
A ATCGGATGAT TCATCCACAG
GAAGTGAAGC TTAACCAAGG TTCAGACAAA GATAATTCTT GGATTAGTTT AAGCGCAGCG
ANTCCATTGA ATAACATTGG CTATGTTTTT CCTAATTCNA TGAATACGCT TGATGTTCAA
ATAGAAGAAC GCTCTGGTCG CTACGGAGAT ATTAACGAAT ACTTTGTTAA TGATAAAACC
TATACAAATA CATTTGCTAA AATTAGTAAA AATTATGGCA AGACTGTTGA AAATGGTACT
TACGAATATT TAACAGTGGT TGGGAAAACG AATGAAGAAA TCGCAGCTCT TTCTAAAAAC
AAAGGCTATA CTGTTCTAGA AAATACAGCA AACTTACAAG CCATTGAAGC AGGTAATTAT
GTCATGATGA ATACATGGAA TAATGACCAA GAAATTGCAG GACTGTATGC GTATGATCCA
ATGTCGGTTA TTTCAGAAAA AATTGATAAC GGTGTTTATC GCTTAACTCT TGCGAATCCT
TTACAAAATA ATGCATCC

EF087-4 (SEQ ID NO:332)
NRMIHPQE
VKLNQGSDKD NSWISLSAAX PLNNIGYVFP NSMNTLDVQI EERSGRYGDI NEYFVNDKTY
TNTFAKISKN YGKTVENGTY EYLTVVGKTN EEIAALSKNK GYTVLENTAN LQAIEAGNYV
MMNTWNNDQE IAGLYAYDPM SVISEKIDNG VYRLTLANPL QNNAS

EF088-1 (SEQ ID NO:333)
TAACTGGTGG GATTGGCAAA TTGGTTCCGC GCAGCGCTAA CAGATACATT GATTTTATTA
CATGATGACC TATTGAATAC AGATGCAGAA AAATTAAATA AATTTACTGC TCCGCTGATG
CTGTATGCAA AAGATCCAAA CATACAATGG CCAATTTATC GTGCAACAGG AGCTAACTTA
ACAGATATTT CAATCACCGT TTTAGGTACT GGACTTTTGT TAGAAGATAA TCAACGCCTA
GTACAAGTAC AAGAAGCTGT TCCGTCCGTT TTAAAAAGTG TTTCCTCTGG TGATGGCTTA
TATCCTGATG GTTCCTTGAT TCAACATGGT TGTTTTCCGT ACAACGGCAG TTACGGGAAT
GAGTTGCTAA AAGGGTTTGG ACGAATTCAG ACTATTTTAC AAGGTTCCGA CTGGGAGATG
AATGACCCTA ACATTAGTAA TTTATTTAAT GTTGTGGATA AAGGTTACTT ACAATTGATG
GTAAATGGAA AAATGCCATC GATGGTTTCT GGTAGAGTA TTTCCAGAGC GCCAGAAACG
AATCCTTTTA CTACAGAGTT TGAATCGGGT AAAGAAACAA TAGCTAATTT AACCTTAATT
GCAAAATTTG CACCAGAAAA TTTAAGAAAT GACATTTATA CATCTATCCA AACGTGGCTT
CAACAAAGTG GGTCATACTA TCATTTCTTT AAAAAACCAA GAGATTTTGA AGCGTTAATT
```

TABLE 1-continued

Nucleotide and Amino Acid Seqeuences of E. faecalis Genes.

```
GACTTGAAAA ATGTAGTGAA TAGTGCGTCA CCTGCCCAAG CGACACCAAT GCAATCTTTA
AATGTATATG GTTCGATGGA TCGAGTCCTA CAGAAAAATA ACGAATATGC GGTGGGGATC
AGTATGTATT CACAACGTGT CGGAAACTAT GAATTTGGGA ATACGAAAA TAAAAAAGGC
TGGCATACAG CAGACGGCAT GCTTTATTTA TACAATCAAG ACTTTGCTCA GTTTGATGAA
GGATACTGGG CAACGATCGA TCCATATCGA TTACCAGGAA CGACAGTTGA CACAAGAGAA
TTGGCAAATG GTGCTTATAC AGGGAAACGC AGTCCCCAGT CATGGGTAGG TGGCTCAAAT
AATGGACAGG TTGCCTCTAT AGGAATGTTT TTAGATAAAA GTAATGAAGG AATGAACTTA
GTTGCTAAAA AATCTTGGTT CTTATTAGAT GGTCAAATCA TTAATTTGGG AAGTGGCATT
ACTGGTACGA CAGATGCTTC GATTGAAACA ATCCTCGATA ATCGGATGAT TCATCCACAG
GAAGTGAAGC TTAACCAAGG TTCAGACAAA GATAATTCTT GGATTAGTTT AAGCGCAGCG
ANTCCATTGA ATAACATTGG CTATGTTTTT CCTAATTCNA TGAATACGCT TGATGTTCAA
ATAGAAGAAC GCTCTGGTCG CTACGAGAT ATTAACGAAT ACTTTGTTAA TGATAAAACC
TATACAAATA CATTTGCTAA AATTAGTAAA AATTATGCA AGACTGTTGA AAATGGTACT
TACGAATATT TAACAGTGGT TGGGAAAACG AATGAAGAA TCGCAGCTCT TTCTAAAAAC
AAAGGCTATA CTGTTCTAGA AAATACAGCA ACTTACAAG CCATTGAAGC AGGTAATTAT
GTCATGATGA ATACATGGAA TAATGACCAA GAAATTGCAG GACTGTATGC GTATGATCCA
ATGTCGGTTA TTTCAGAAAA AATTGATAAC GGTGTTTATC GCTTAACTCT TGCGAATCCT
TTACAAAATA ATGCATCCGT TTCTATTGAA TTTGATAAGG GCATTCTTGA AGTAGTCGCA
GCGGACCCAG AAATTTCTGT TGACCAAAAT ATTATCACTT TAAATAGTGC GGGGTTAAAT
GGCAGCTCGC GTTCAATCAT TGTTAAAACA ACTCCTGAAG TAACGAAAGA AGCGTTAGAA
AAATTAATTC AGGAACAAAA AGAACACCAA GAAAAAGACT ACACCGCAAG CAGCTGGAAA
GTCTACAGCG AAGCATTGAA ACAAGCACAA ACTGTGGCAG ATCAAACAAC AGCAACGCAA
GCAGAAGTAG ACCAAGCAGA AACAGAGTTA CGTTCGGCAG TGAAGCAATT GGTAAAAGTG
CCAACTAAAG AAGTAGATAA AACCAACTTG TTGAAAATCA TCAAAGAAAA CGAGAAACAC
CAAGAAAAAG ACTACACCGC AAGCAGTTGG AAAGTCTACA GTGAAGCATT GAAGCAAGCG
CAAACTGTGG CAGATCAAAC AACAGCAACG CAAGCAGAAG TAGACCAAGC AGAAGCAAAA
CTACGTTCGG CAGTGAAGCG ATTAACATTG AAAAATAGTG GGGAAAATAA AAAGGAGCAA
AAAAATGGGG GGAATAATGG ACACTTAAAT ACTAGTACAG GAGTTGATCA AACTGGTACG
AAACAAGTTA AGCCATCAAG CCAAGGTGGT TTCAGAAAAG CTAGCCAATT TTTACCGAGC
ACAGGAGAAA AGAAATCGAT CGCGCTTGTG ATTATTGGTC TTCTAGTTAT CGCCAGTGGG
TGTCTTTTAG TTTTTCGTAA AAGTAAATCG AAGAAGTAA

EF088-2 (SEQ ID NO:334)
LVGLANWFRA ALTDTLILLH DDLLNTDAEK LNKFTAPLML YAKDPNIQWP IYRATGANLT
DISITVLGTG LLLEDNQRLV QVQEAVPSVL KSVSSGDGYL PDGSLIQHGY FPYNGSYGNE
LLKGFGRIQT ILQGSDWEMN DPNISNLFNV VDKGYLQLMV NGKMPSMVSG RSISRAPETN
PFTTEFESGK ETIANLTLIA KFAPENLRND IYTSIQTWLQ QSGSYYHFFK KPRDFEALID
LKNVVNSASP AQATPMQSLN VYGSMDRVLQ KNNEYAVGIS MYSQRVGNYE FGNTENKKGW
HTADGMLYLY NQDFAQFDEG YWATIDPYRL PGTTVDTREL ANGAYTGKRS PQSWVGGSNN
GQVASIGMFL DKSNEGMNLV AKKSWFLLDG QIINLGSGIT GTTDASIETI LDNRMIHPQE
VKLNQGSDKD NSWISLSAAX PLNNIGYVFP NSMNTLDVQI EERSGRYGDI NEYFVNDKTY
TNTFAKISKN YGKTVENGTY EYLTVVGKTN EEIAALSKNK GYTVLENTAN LQAIEAGNYV
MMNTWNNDQE IAGLYAYDPM SVISEKIDNG VYRLTLANPL QNNASVSIEF DKGILEVVAA
DPEISVDQNI ITLNSAGLNG SSRSIIVKTT PEVTKEALEK LIQEQKEHQE KDYTASSWKV
YSEALKQAQT VADQTTATQA EVDQAETELR SAVKQLVKVP TKEVDKTNLL KIIKENEKHQ
EKDYTASSWK VYSEALKQAQ TVADQTTATQ AEVDQAEAKL RSAVKRLTLK NSGENKKEQK
NGGNNGHLNT STGVDQTGTK QVKPSSQGGF RKASQFLPST GEKKSIALVI IGLLVIASGC
LLVFRKSKSK K

EF088-3 (SEQ ID NO:335)
A ACTCCTGAAG TAACGAAAGA AGCGTTAGAA
AAATTAATTC AGGAACAAAA AGAACACCAA GAAAAAGACT ACACCGCAAG CAGCTGGAAA
GTCTACAGCG AAGCATTGAA ACAAGCACAA ACTGTGGCAG ATCAAACAAC AGCAACGCAA
GCAGAAGTAG ACCAAGCAGA AACAGAGTTA CGTTCGGCAG TGAAGCAATT GGTAAAAGTG
CCAACTAAAG AAGTAGATAA AACCAACTTG TTGAAAATCA TCAAAGAAAA CGAGAAACAC
CAAGAAAAAG ACTACACCGC AAGCAGTTGG AAAGTCTACA GTGAAGCATT GAAGCAAGCG
CAAACTGTGG CAGATCAAAC AACAGCAACG CAAGCAGAAG TAGACCAAGC AGAAGCAAAA
CTACGTTCGG CAGTGAAGCG ATTAACATTG AAAAATAGTG GGGAAAATAA AAAGGAGCAA
AAAAATGGGG GGAATAATGG ACACTTAAAT ACTAGTACAG GAGTTGATCA AACTGGTACG
AAACAAGTTA AGCCATCAAG CCAAGGTGGT TTCAGAAAAG CTAGCCAATT TTTACCGAGC
ACAGGAGAAA AGAAA

EF088-4 (SEQ ID NO:336)
T PEVTKEALEK LIQEQKEHQE KDYTASSWKV
YSEALKQAQT VADQTTATQA EVDQAETELR SAVKQLVKVP TKEVDKTNLL KIIKENEKHQ
EKDYTASSWK VYSEALKQAQ TVADQTTATQ AEDQAEAKL RSAVKRLTLK NSGENKKEQK
NGGNNGHLNT STGVDQTGTK QVKPSSQGGF RKASQFLPST GEKK

EF089-1 (SEQ ID NO:337)
TGACAGATAC ACCTGCTAAC ACAGGAAACT AAGAACGACA GCATACACGC AAGATCGGGA
TATAGGTCAA AAATTTTTTG GCTTATCTTT CGGTCTTTTG GTGCTTATAA TACAACAAAG
AATGACAGAC ATAGGAGAAT GAATATGAAC AGATGGAAAG TATATGCAAC GGTAATCGCT
TGTATGTTAT TTGGCTGGAT TGGCGTGGAG GCGCACGCTT CTGAATTTAA TTTTGCGGTC
ACACCAACAA TTCCCGAAAA TCAAGTGGAT AAATCAAAAA CCTACTTTGA CTTAAAAATG
GCGCCTGGTG CCAAACAAAC CGTAGAAATT CAGTTACGCA ATGATACAGA TGAAGACATT
ACCATTGAAA ATACGGTGAA CTCAGCGACA ACAAATTTAA ATGGCTGAGT AGAATATGGC
CAAAACGGGA TCAAACCTGA CAAAACCTTA CGTTTTAACT TAAAAGATTA TGTGGAAGCA
```

TABLE 1-continued

Nucleotide and Amino Acid Seqeuences of *E. faecalis* Genes.

```
CCGAAAGAAA TCATCTTGCC GAAGCATTCC CAAAAGACCT TACCTTTAAC CATTACGATG
CCTAAAGATT CTTTTGATGG CGTGATGGCT GGCGGTATAA CACTCAAAGA GAAAAAGAAA
GAAACAACGA CTTCTGCGGA TCAATCAAAA GGGTTAGCTA TTAATAATGA ATACTCCTAT
GTTGTGGCTA TTATTCTTCA GCAAAATGAG ACAAAGGTTC AACCAGATTT AAAATTACTG
GGGGTTAAAC CAGGCCAAGT CAACGCGCGA AACGTCATCA ATGTTTCTTT ACAAAACCCA
CAAGCGGCCT ATTTAAACCA ATTACATTTA ATCAACACTG TTTCAAAAGG AGGCGAAACG
CTTTACCAAT CCGATACTGA GGATATGCAA GTGGCGCCAA ACTCTAACTT TAGTTACCCA
ATTTCTTTAA AAGGGGAACG ATTAACGCCA GGAAAATATG TCTTGAAATC AACGGCCTAT
GGTGTAAAAG ATGAAAAGGG CACCTATCAA GTCAAAGGCG CCAATGGTGA AGAACGGTAC
CTGTACAAAT GGGAATTTAC AAAAGAATTT ACTATTTCTG GGGACGTCGC TAAAGAATTA
AATGAAAAAG ACGTAACCAT TAAGGAACC AATTGGTGGT TGTATCTACT GATTGCATTA
ATCATTCTAG CGCTGCTCTT ATTGATTTTC TTCTTGTATC GTAAAAAGAA AAAGAGGAA
GAACAACAAT CTGAGCAATA A

EF089-2 (SEQ ID NO:338)
MNR WKVYATVIAC
MLFGWIGVEA HASEFNFAVT PTIPENQVDK SKTYFDLKMA PGAKQTVEIQ LRNDTDEDIT
IENTVNSATT NLNGVVEYGQ NGIKPDKTLR FNLKDYVEAP KEIILPKHSQ KTLPLTITMP
KDSFDGVMAG GITLKEKKKE TTTSADQSKG LAINNEYSYV VAIILQQNET KVQPDLKLLG
VKPGQVNARN VINVSLQNPQ AAYLNQLHLI NTVSKGGETL YQSDTEDMQV APNSNFSYPI
SLKGERLTPG KYVLKSTAYG VKDEKGTYQV KGANGEERYL YKWEFTKEFT ISGDVAKELN
EKDVTIKGTN WWLYLLIALI ILALLLLIFF LYRKKKEEE QQSEQ

EF089-3 (SEQ ID NO:339)
T CTGAATTTAA TTTTGCGGTC
ACACCAACAA TTCCCGAAAA TCAAGTGGAT AAATCAAAAA CCTACTTTGA CTTAAAAATG
GCGCCTGGTG CCAAACAAAC CGTAGAAATT CAGTTACGCA ATGATACAGA TGAAGACATT
ACCATTGAAA ATACGGTGAA CTCAGCGACA ACAAATTTAA ATGGCGTAGT AGAATATGGC
CAAAACGGGA TCAAACCTGA CAAAACCTTA CGTTTTAACT AAAAGATTA TGTGGAAGCA
CCGAAAGAAA TCATCTTGCC GAAGCATTCC CAAAAGACCT TACCTTTAAC CATTACGATG
CCTAAAGATT CTTTTGATGG CGTGATGGCT GGCGGTATAA CACTCAAAGA GAAAAAGAAA
GAAACAACGA CTTCTGCGGA TCAATCAAAA GGGTTAGCTA TTAATAATGA ATACTCCTAT
GTTGTGGCTA TTATTCTTCA GCAAAATGAG ACAAAGGTTC AACCAGATTT AAAATTACTG
GGGGTTAAAC CAGGCCAAGT CAACGCGCGA AACGTCATCA ATGTTTCTTT ACAAAACCCA
CAAGCGGCCT ATTTAAACCA ATTACATTTA ATCAACACTG TTTCAAAAGG AGGCGAAACG
CTTTACCAAT CCGATACTGA GGATATGCAA GTGGCGCCAA ACTCTAACTT TAGTTACCCA
ATTTCTTTAA AAGGGGAACG AT

EF089-4 (SEQ ID NO:340)
SEFNFAVT PTIPENQVDK SKTYFDLKMA PGAKQTVEIQ LRNDTDEDIT
IENTVNSATT NLNGVVEYGQ NGIKPDKTLR FNLKDYVEAP KEIILPKHSQ KTLPLTITMP
KDSFDGVMAG GITLKEKKKE TTTSADQSKG LAINNEYSYV VAIILQQNET KVQPDLKLLG
VKPGQVNARN VINVSLQNPQ AAYLNQLHLI NTVSKGGETL YQSDTEDMQV APNSNFSYPI
SLKGER

EF090-1 (SEQ ID NO:341)
TAGTCTCTAA GAAATAAACC TAAAATTATT GATATAAAGG ATGAACAAAT GAAAAAGAA
GAAATGCAAA TGCGTAATAC ACGTCGTCAA AAATCAGGAA AAAATAATAA AAAGAAAGTA
ATTATTACTT CTTTGGTTGG ACTAGCTCTG GTTGCTGGGG GCAGTTATGT TTATTTTCAA
AGTCACTTTT TNCCAACCAC AAAAGTAAAT GGAGTTTCTG TAGGCTGGTT AAATGTAAAT
GCTGCAGAAG AAAAATTAGC GCAAGTTAAT CAAACCGAAG AAGTTGTGGT TCAAACGGGG
ACAAAAGAAG AAAAAATTCA ACTTCCTAAA AAATACCAAT TGGATCAAAA ATTTTTAAAA
GACCATTTAC ACAGTAGCAA GGTGAAGCTA CCGTTAAACG AGGCATTCAA AAAAGAACTA
GAAGCCAAAT TAGCAACTTT GAGTTTTCCA GAGGGGAAAC CAAGCAAAAA TGCGAGTATC
CGTCGAGGCA ATGGCACTTT TGAAATTGTT TGAAATTGTT CCCGAAGAAC AGTGGACACA
CAGCGCTTAA ACCAGCAGAT TATTGCGGAT GTTGAAGCGG AAAAGGCAA CTATCAATAT
AATGCCAAAG ATTTTTATAA AGCCCCTGAA ATTACAAAAG AGGATCAAAC GTTAAAGGCA
ACATTGACAA CGCTCAATAA CAAGTTAAAT AAAACAATTA CAGTTGATAT TAATGGTGAA
AAAGTAGCCT TTGATAAAAC ACAAATTCAA AACGTGCTGA ATGATGATGG CACAATCAAC
AAAGAAAAAC TAACTACTTG GGTGACACAA TTAGAAACAA CATATGGTTC TGCTAATCAA
CCAGTTTTAT TTACAGATGT TCACGGCACG ACACGTCGTT TTAAAAACAA CGGAAGTTAT
GGCTGGTCGA TTGATGGGC CAAAACGCAA GAACTACTAG TAAACGCGCT GAATAGCCAA
GAACAAACGA ATGCAATCAC TGCTCCGTTG GTTGGTGATA CCAAAGAAA TATTAAAATT
GCCAATAATT ACATTGAAAT TGATTTAAAA GATCAAAAAA TGTATTGTTT CATTGATGGC
AAAAAATAG TCACCACAGA TGTCATTACT GGCAGATATA ACAAAGGAAC CGCAACAGTA
CCAGGATTCC ATACAATTTT ATATCGGACA ACCGATGTGA ATTTAGAAGG TCAAATGCTT
GATGGTTCTC GATACAGTGT GCCAGTAAAA TATTGGATGC CGTTATTAAG TCAAGGGGGC
GTTGTCACAC AAATCGGGAT TCATGACTCC GACCATAAAT TGGATAAGTA TGGCGATAAA
GAAGCCTTTA AAACCGATGC TGGTAGTAAT GGCTGTATCA ATACGCCAGG AACAGAAGTT
TCAAAAATCT TTGATGTATC CTATGACGGA ATGCCGGTAA TTATTTATGG ACATATCTAT
GATGATGCAC CAGGTGAATT TGATAAACCT GTAGATTACG GCGAAGAAGT ATAA

EF090-2 (SEQ ID NO:342)
MRNTRRQK SGKNNKKKVI ITSLVGLALV AGGSYVYFQS
HFXPTTKVNG VSVGWLNVNA AEEKLAQVNQ TEEVVVQTGT KEEKIQLPKK YQLDQKFLKD
HLHSSKVKLP LNEAFKKELE AKLATLSFPE GKPSKNASIR RGNGTFEIVP EEQGTVVDTQ
RLNQQIIADV EAGKGNYQYN AKDFYKAPEI TKEDQTLKAT LTTLNNKLNK TITVDINGEK
```

TABLE 1-continued

Nucleotide and Amino Acid Seqeuences of E. faecalis Genes.

VAFDKTQIQN VLNDDGTINK EKLTTWVTQL ETTYGSANQP VLFTDVHGTT RRFKNNGSYS
WSIDGAKTQE LLVNALNSQE QTNAITAPLV GDTKENSKIA NNYIEIDLKD QKMYCFIDGK
KIVTTDVITG RYNKGTATVP GFHTILYRTT DVNLEGQMLD GSRYSVPVKY WMPLLSQGGV
VTQIGIHDSD HKLDKYGDKE AFKTDAGSNG CINTPGTEVS KIFDVSYDGM PVIIYGHIYD
DAPGEFDKPV DYGEEV

EF090-3 (SEQ ID NO:343)
CAC AAAAGTAAAT GGAGTTTCTG TAGGCTGGTT AAATGTAAAT
GCTGCAGAAG AAAAATTAGC GCAAGTTAAT CAAACCGAAG AAGTTGTGGT TCAAACGGGG
ACAAAAGAAG AAAAAATTCA ACTTCCTAAA AAATACCAAT TGGATCAAAA ATTTTTAAAA
GACCATTTAC ACAGTAGCAA GGTGAAGCTA CCGTTAAACG AGGCATTCAA AAAAGAACTA
GAAGCCAAAT TAGCAACTTT GAGTTTTCCA GAGGGGAAAC CAAGCAAAAA TGCGAGTATC
CGTCGAGGCA ATGGCACTTT TGAAATTGTT CCCGAAGAAC AAGGCACAGT AGTGGACACA
CAGCGCTTAA ACCAGCAGAT TATTGCGGAT GTTGAAGCGG GAAAAGGCAA ATATCAATAT
AATGCCAAAG ATTTTTATAA AGCCCCTGAA ATTACAAAAG AGGATCAAAC GTTAAAGGCA
ACATTGACAA CGCTCAATAA CAAGTTAAAT AAAACAATTA CAGTTGATAT TAATGGTGAA
AAAGTAGCCT TTGATAAAAC ACAAATTCAA AACGTGCTGA ATGATGATGG CACAATCAAC
AAAGAAAAAC TAACTACTTG GGTGACACAA TTAGAAACAA CATATGGTTC TGCTAATCAA
CCAGTTTTAT TTACAGATGT TCACGGCACG ACACGTCGTT TTAAAAACAA AGGAAGTTAT
GGCTGGTCGA TTGATGGGGC CAAAACGCAA GAACTACTAG TAAACGCGCT GAATAGCCAA
GAACAAACGA ATGCAATCAC TGCTCCGTTG GTTGGTGATA CCAAAGAAAA TAGTAAAATT
GCCAATAATT ACATTGAAAT TGATTTAAAA GATCAAAAAA TGTATTGTTT CATTGATGGC
AAAAAAAATAG TCACCACAGA TGTCATTACT GGCAGATATA ACAAAGGAAC CGCAACAGTA
CCAGGATTCC ATACAATTTT ATATCGGACA ACCGATGTGA ATTTAGAAGG TCAAATGCTT
GATGGTTCTC GATACAGTGT GCCAGTAAAA TATTGGATGC CGTTATTAAG TCAAGGGGGC
GTTGTCACAC AAATCGGGAT TCATGACTCC GACCATAAAT TGGATAAGTA TGGCGATAAA
GAAGCCTTTA AAACCGATGC TGGTAGTAAT GGCTGTATCA ATACGCCAGG AACAGAAGTT
TCAAAAATCT TTGATGTATC CTATGACGGA ATGCCGGTAA TTATTTATGG ACATATCTAT
GATGATGCAC CAGGTGAATT TGATAAACCT GTAGATTACG GCGAAGAAGT AT

EF090-4 (SEQ ID NO:344)
TKVNG VSVGWLNVNA AEEKLAQVNQ TEEVVVQTGT KEEKIQLPKK YQLDQKFLKD
HLHSSKVKLP LNEAFKKELE AKLATLSFPE GKPSKNASIR RGNGTFEIVP EEQGTVVDTQ
RLNQQIIADV EAGKGNYQYN AKDFYKAPEI TKEDQTLKAT LTTLNNKLNK TITVDINGEK
VAFDKTQIQN VLNDDGTINK EKLTTWVTQL ETTYGSANQP VLFTDVHGTT RRFKNNGSYG
WSIDGAKTQE LLVNALNSQE QTNAITAPLV GDTKENSKIA NNYIEIDLKD QKMYCFIDGK
KIVTTDVITG RYNKGTATVP GFHTILYRTT DVNLEGQMLD GSRYSVPVKY WMPLLSQGGV
VTQIGIHDSD HKLDKYGDKE AFKTDAGSNG CINTPGTEVS KIFDVSYDGM PVIIYGHIYD
DAPGEFDKPV DYGEEV

EF091-1 (SEQ ID NO:345)
TAATTGGNGG AGATTTTTAT GGCTAAAAAA GGCGGATTTT TCTTAGGNGC AGTAATTGGT
GGAACAGCAG CAGCCGTTGC CGCATTATTA CTTGCACCAA AATCAGGTAA AGAATTACGT
GATGATTTAT CAAATCAAAC AGATGATTTA AAAAACAAAG CGCAAGATTA CACAGATTAT
GCTGTTCAAA AGGAACAGA ATTAACAGAA ATCGCAAAAC AAAAAGCCGG CGTTTTATCA
GATCAAGCCT CTGATTTGGC AGGTTCTGTC AAAGAATAAA CAAAAGATTC ATTGGATAAA
GCACAAGGTG TTTCTGGCGA CATGCTTGAT AACTTTAAAA AACAAACAGG TGATTTATCT
GATCAATTTA AAAAAGCAGC TGACGATGCT CAAGATCACG CAGAAGATTT AGGTGAAATT
GCCGAAGATG CAGCAGAAGA TATCTATATT GACGTTAAAG ATTCTGCGGC AGCGGCCAAA
GAAACTGTTT CTGCTGGTGT CGATGAAGCA ANAGAAACCA CCAAAGATGT TCCTGAAAAA
GCTGCAGAAG CAAAAGAAGA TGTTAAAGAT GCAGCGAAAG ACGTAAAAAA AGAATTTAAA
GGGTAA

EF091-2 (SEQ ID NO:346)
MAKKG GFFLGAVIGG TAAAVAALLL APKSGKELRD DLSNQTDDLK NKAQDYTDYA
VQKGTELTEI AKQKAGVLSD QASDLAGSVK EKTKDSLDKA QGVSGDMLDN FKKQTGDLSD
QFKKAADDAQ DHAEDLGEIA EDAAEDIYID VKDSAAAAKE TVSAGVDEAX ETTKDVPEKA
AEAKEDVKDA AKDVKKEFKG

EF091-3 (SEQ ID NO:347)
AT CAAATCAAAC AGATGATTTA AAAAACAAAG CGCAAGATTA CACAGATTAT
GCTGTTCAAA AGGAACAGA ATTAACAGAA ATCGCAAAAC AAAAAGCCGG CGTTTTATCA
GATCAAGCCT CTGATTTGGC AGGTTCTGTC AAAGAATAAA CAAAAGATTC ATTGGATAAA
GCACAAGGTG TTTCTGGCGA CATGCTTGAT AACTTTAAAA AACAAACAGG TGATTTATCT
GATCAATTTA AAAAAGCAGC TGACGATGCT CAAGATCACG CAGAAGATTT AGGTGAAATT
GCCGAAGATG CAGCAGAAGA TATCTATATT GACGTTAAAG ATTCTGCGGC AGCGGCCAAA
GAAACTGTTT CTGCTGGTGT CGATGAAGCA ANAGAAACCA CCAAAGATGT TCCTGAAAAA
GCTGCAGAAG CAAAAGAAGA TGTTAAAGAT GCAGCGAAAG ACGTAAAAAA AGAATTTAAA
GGGTAA

EF091-4 (SEQ ID NO:348)
SNQTDDLK NKAQDYTDYA
VQKGTELTEI AKQKAGVLSD QASDLAGSVK EKTKDSLDKA QGVSGDMLDN FKKQTGDLSD
QFKKAADDAQ DHAEDLGEIA EDAAEDIYID VKDSAAAAKE TVSAGVDEAX ETTKDVPEKA
AEAKEDVKDA AKDVKKEFKG

EF092-1 (SEQ ID NO:349)

TABLE 1-continued

Nucleotide and Amino Acid Seqeuences of *E. faecalis* Genes.

```
TAAGGGATG  AAGAAAAAAT  GGCAAAAAAA  ACAATTATGT  TAGTTTGTTC  CGCAGGAATG
AGCACGAGTT  TATTAGTAAC  AAAAATGCAA  AAAGTAGTAG  AAGATCGTGG  CATGGAAGCA
GACATCTTTG  CAGTATCGGC  TTCTGAAGCA  GATACAAACT  TGGAAAATAA  AGAGGTGAAT
GTTTTACTTT  TAGGTCCACA  AGTTCGTTTC  ATGAAAGGGC  AATTTGAACA  AAAATTACAA
CCAAAAGGGA  TTCCTTTAGA  TGTAATTAAC  ATGGCAGATT  ATGGCATGAT  GAATGGCGAA
AAAGTTTTAG  ATCAAGCAAT  CTCATTAATG  GGATAA
```

EF092-2 (SEQ ID NO:350)
MAKKT IMLVCSAGMS TSLLVTKMQK AAEDRGMEAD IFAVSASEAD TNLENKEVNV
LLLGPQVRFM KGQFEQKLQP KGIPLDVINM ADYGMMNGEK VLDQAISLMG

EF092-3 (SEQ ID NO:351)
```
AG  AAGATCGTGG  CATGGAAGCA
GACATCTTTG  CAGTATCGGC  TTCTGAAGCA  GATACAAACT  TGGAAAATAA  AGAGGTGAAT
GTTTTACTTT  TAGGTCCACA  AGTTCGTTTC  ATGAAAGGGC  AATTTGAACA  AAAATTACAA
CCAAAAGGGA  TTCCTTTAGA  TGTAATTAAC  ATGGCAGATT  ATGGCATGAT  GAATGGCGAA
AAAGTTTTAG  ATCAAGCAAT  CTCATTAATG  GGAT
```

EF092-4 (SEQ ID NO:352)
EDRGMEAD IFAVSASEAD TNLENKEVNV
LLLGPQVRFM KGQFEQKLQP KGIPLDVINM ADYGMMNGEK VLDQAISLMG

EF093-1 (SEQ ID NO:353)
```
TAGTTTTTTT  CCGATAAAGG  GAGAATTTTA  ATGAGGCAAA  AATATTCAGG  AAACTTATTG
TTCACGGCCA  TGGCCATTGT  TTATTTGATG  AGTTTTCTCG  CCCTTCAGTT  ACTAGAAGAA
CGTCAGTTAA  CACAAAAATT  TACGCAAGCT  ACCCAGGAAT  ACTATGCAGG  GAAAAGTATC
TTTCATTTAT  TTCTTGCAGA  TGTTAAACAA  AATAGACGAA  AGTTAAAAAC  AGAAGAAAGG
CTCGTATACG  CGCAAGTGAC  CCTCGATTAT  ACATACAAAA  ATGAACAATT  AAGAATAACT
GTTTTATTAA  ACAAATCTGG  TCGAAAATAC  CAATATCAAG  AGAGAGTTTC  TCATCAAAAA
AAAGCGGAAA  CAATACTGGA  ATAG
```

EF093-2 (SEQ ID NO:354)
M RQKYSGNLLF TAMAIVYLMS FLALQLLEER QLTQKFTQAT QEYYAGKSIF
HLFLADVKQN RRKLKTEERL VYAQVTLDYT YKNEQLRITV LLNKSGRKYQ YQERVSHQKK
AETILE

EF093-3 (SEQ ID NO:355)
```
CCTTCAGTT  ACTAGAAGAA
CGTCAGTTAA  CACAAAAATT  TACGCAAGCT  ACCCAGGAAT  ACTATGCAGG  GAAAAGTATC
TTTCATTTAT  TTCTTGCAGA  TGTTAAACAA  AATAGACGAA  AGTTAAAAAC  AGAAGAAAGG
CTCGTATACG  CGCAAGTGAC  CCTCGATTAT  ACATACAAAA  ATGAACAATT  AAGAATAACT
GTTTTATTAA  ACAAATCTGG  TCGAAAATAC  CAATATCAAG  AGAGAGTTTC  TCATCAAAAA
AAAGCGGAAA  CAATACTGG
```

EF093-4 (SEQ ID NO:356)
LQLLEER QLTQKFTQAT QEYYAGKSIF
HLFLADVKQN RRKLKTEERL VYAQVTLDYT YKNEQLRITV LLNKSGRKYQ YQERVSHQKK
AETI

EF094-1 (SEQ ID NO:357)
```
TAAACATTTG  AGACATTCAG  AGGTGAATGT  CACTTTTTTA  TTACTCAAAA  ACGAAAGGGG
ATTAATTATA  TGAAAAAAAC  AACATTTAAA  AATTGGTCGT  TATTTGCGAC  TTTGGCTCTA
TTAAGTCAAA  CAATTGGCGG  AACGATTGGT  CCTACGATTG  CTTTTGCCGA  TGAAATTACT
CACCCTCAAG  AGGTAACAAT  TCATTATGAC  GTAAGTAAAC  TGTATGAAGT  TGACGGAACT
TTTAGCGATG  GCAGCACGCT  CTCAGAACGT  ACTACGTCAT  TATATGCAGA  ATACAATGGT
GCAAAACAAA  CAGTATTTTG  TATTGAACCA  GGTGTTAGTA  TTCCAACAGA  AGTGACGCAC
GGTTATCAGA  AAAACCCTTT  GCCATCAATG  TCTGATAAAG  CGAAACTAGT  ATCGGTTCTT
TGGGAAAAGG  CTGGAACAGA  TATTGATACA  AATATGGTTA  CACAAAAGAT  GATTTGGGAA
GAAGTGAACG  GTTATAAACT  CCATTCCATA  AAAAGATTAG  GTGGTGCTTC  AGTTGATATA
AAATCTATTG  AAGGAAAAAT  TAATAAGGCA  ATTGAGGAGT  ATCAAAAAAA  ACCAAGTTTT
CATAATACCA  CTGTAAAAAC  AATTTTAGGT  CAATCGACAA  CTTTAATAGA  TAAAAATGAA
TTAAATTTAT  CTGAGTTTGA  TAAAGTCGTC  CAAAATACGG  CGAATATAGA  TTACCGTGTA
ATTGGGAATC  AATTAGTGCT  TACTCCAAAC  TCTAATTCCA  AATCAGGAAC  ATTAACATTG
AAAAAATCAG  CTGGTACTGG  AACTCCAGTC  GCTTATAAAA  AAGCAGGACT  TCAAACTGTG
ATGGCTGGTG  CGCTTGATAA  GCCCAATACC  TACGCTATTA  AAATTAATGT  GGAAACTAAG
GGTTCTTTAA  AGATCAAAAA  AATCGATAAA  GAATCAGGTG  ATATTGTACC  AGAAACGGTT
TTCCATTTAG  ATTTTGGGAA  AGCTTTACCT  TCAAAAGATG  TGACAACGAA  TAAAGATGGG
ATTTCTATTT  TGGATGGAAT  TCCCCATGGT  ACAAAGGTAA  CTATTACTGA  AAAATCGGTG
CCAGATCCTT  ATATGATTGA  TACCACACCC  ATGGCTGCCA  CCATTAAAGC  GGGCGAGACC
ATTTCCATGA  CTTCGAAAAA  TATGCGACAA  AAAGGTCAAA  TTCTTTTAGA  GAAGACTGGG
GTAGAAACAG  GTACTGATCT  TTGGAATGAC  AATTATTCTC  TAGCTGGAAA  TACATTTGCC
ATTCGTAAAG  ACAGCCCAGC  TGGTGAAATT  GTCCAAGAAA  TAACAACGGA  TGAAAAGGT
CGTGCGGAAA  CACCAAAAGA  GCTTGCTAAT  GCTTTGGAAC  TGGGAACCTA  TTACGTGACA
GAAACTAAT  CTAGTAATGG  TTTCGTGAAT  ACCTTCAAAC  CAACAAAAGT  CGAGTTAAAA
TATGCCAATC  AAACCGTGGC  TCTTGTTACC  CGTAACGTAA  AAGGGCAAAA  CCAAGAAATT
ACTGGGGAAA  CCACTTTGAC  AAAAGAAGAC  AAAGATACCG  GTAATGAGAG  TCAAGGGAAA
GCTGAGTTTA  AAGGAGCTGA  ATATACTCTC  TTTACTGCAA  AAGATGGTCA  AGCTGTTAAA
```

TABLE 1-continued

Nucleotide and Amino Acid Seqeuences of E. faecalis Genes.

TGGAGTGAAG CTTTTAAAAC AGAATTAGTG AAGGGAACGA AAGCTTCTGA TGAAACAGTG
ACTTTGGCTT TAGATGAAAA GAACCAAGTT GCCGTTAAAC ACCTAGCAAT TAACGAGTAT
TTCTGGCAAG AAACCAAAGC ACCTGAAGGA TATACTTTGG ATGAAACGAA ATGTCCTGTA
TCCATCAAAA AAGTTGATAA TAACGAAAAA AATGCCGTAA TTACTCGAGA TGTTACGGCA
AAAGAACAAG TTATTCGCTT TGGCAAAGAT TTCTTTAAAT TTGCTGGATC GGCTGATGGC
ACTGCCGAAA CTGGATTTAA CGACTTATCT TTTAAAGTGT CGCCATTGGA AGGGACCAAN
GAAATCACAG GTGCTGAAGA TAAAGCGACC ACAGCTTGTA ACGAGCAATT AGGTTTTGAT
GGCTATGGTA AGTTTGAAAA TCTTCCTTAT GGGGATTATT TACTTGAAGA AATAGAGGCT
CCAGAAGGAT TTCAAAAGAT TACACCACTA GAAATCCGTT CTACATTTAA GGAAAACAAA
GACGACTATG CGAAGAGTGA GTATGTCTTT ACCATTACCG AAGAAGGACA AAAACAACCA
ATTAAGATGG TGACCGTTCC TTACGAGAAA CTAACTAACA ACGAGTTTTC TGTTAGTCTG
AACCGTTTGA TGCTTTATGA TTTGCCCGAG AAAGAAGATA GTTTGACTTC TCTTGCGACT
TGGAAAGACG GAAATAAAAA ATTGAATACC CTTGATTTTA CCGAGCTAGT TGATAAATTG
AGATATAACT TGCATGAAAT CAAAGAAGAC TGGTATGTCG TAGCTCAAGC CATTGATGTG
GAAGCCACAA AAGCTGCCCA AGAAAAAGAC GAAAAGCCA AACCGGTGGT GATTGCCGAA
ACAACCGCAA CGTTGGCGAA CAAAGAGAAA ACTGGAACTT GGAAAATTCT GCATAAATTA
ACCGCTGAAC AAGTTTTGGA TAAAAGCATC GTCTTGTTCA ATTATGTGTA TGAAAACAAG
GTAGCCTTTG AAGCAGGCAA TGAGCCAGTA GCGAAGGATG CTAGCTTGAA CAATCAAGCA
CAAACCGTCA ATTGTACGAT TGAACGCCAT GTTTCCATCC AAACAAAAGC CCACCTAGAA
GATGGTTCGC AAACTTTTAC TCATGGTGAC GTGATGGATA TGTTTGATGA TGTGTCGGTT
ACCCATGATG TACTGGATGG CTCAAAAGAA GCTTTCGAAA CAATTCTGTA TGCTTTACTA
CCAGATGGTA CGAACAAAGA AATTTGGAAA TCTGGCAAAA TTGAGCATGA AGTGAATGAT
AAAGAATTTA CCAAAACCGT ACTTGCGGAA AAAGTAGATA CCGGAAAGTA TCCAGAAGGA
ACTAAGTTTA CTTTTACGGA AATCAATTAC GAAAAAGATG GAAACGTGAA TGGAAAACAC
AATGAAGATT TGAAAGAAAA ATCTCAAACC TTAACACCAA AAGAAGTGCC AACCATACCG
AGTACGCCAA AACAACCGGA AACACCAGCT GTTCCAAGTA ATTCTCAAGA ATCTAGTCCC
ACAGTGAAGA CATTCCCGCA AACTGGGGAG AAAAATTCCA ACGTTCTACT GTTAGTTGGC
TTTATCTTGA TTTTTTCGAC TGCTGGGTAT TATTTCTGGA ATCGCCGCAA TTAA

EF094-2 (SEQ ID NO:358)
MKKTTFKN WSLFATLALL SQTIGGTIGP TIAFADEITH
PQEVTIHYDV SKLYEVDGTF SDGSTLSERT TSLYAEYNGA KQTVFCIEPG VSIPTEVTHG
YQKNPLPSMS DKAKLVSVLW EKAGTDIDTN MVAQKMIWEE VNGYKLHSIK RLGGASVDIK
SIEGKINKAI EEYQKKPSFH NTTVKTILGQ STTLIDKNEL NLSEFDKVVQ NTANIDYRVI
GNQLVLTPNS NSKSGTLTLK KSAGTGTPVA YKKAGLQTVM AGALDKPNTY AIKINVETKG
SLKIKKIDKE SGDIVPETVF HLDFGKALPS KDVTTDKDGI SILDGIPHGT KVTITEKSVP
DPYMIDTTPM AATIKAGETI SMTSKNMRQK GQILLEKTGV ETGTDLWNDN YSLAGNTFAI
RKDSPAGEIV QEITTDEKGR AETPKELANA LELGTYYVTE TKSSNGFVNT FKPTKVELKY
ANQTVALVTS NVKGQNQEIT GETTLTKEDK DTGNESQGKA EFKGAEYTLF TAKDGQAVKW
SEAFKTELVK GTKASDETVT LALDEKNQVA VKHLAINEYF WQETKAPEGY TLDETKYPVS
IKKVDNNEKN AVITRDVTAK EQVIRFGFDF FKFAGSADGT AETGFNDLSF KVSPLEGTXE
ITGAEDKATT ACNEQLGFDG YGKFENLPYG DYLLEEIEAP EGFQKITPLE IRSTFKENKD
DYAKSEYVFT ITEEGQKQPI KMVTVPYEKL TNNEFSVSLN RLMLYDLPEK EDSLTSLATW
KDGNKKLNTL DFTELVDKLR YNLHEIKEDW YVVAQAIDVE ATKAAQEKDE KAKPVVIAET
TATLANKEKT GTWKILHKLT AEQVLDKSIV LFNYVYENKV AFEAGNEPVA KDASLNNQAQ
TVNCTIERHV SIQTKAHLED GSQTFTHGDV MDMFDDVSVT HDVLDGSKEA FETILYALLP
DGTNKEIWKS GKIEHEVNDK EFTKTVLAEK VDTGKYPEGT KFTFTEINYE KDGNVNGKHN
EDLKEKSQTL TPKEVPTIPS TPKQPETPAV PSNSQESSPT VKTFPQTGEK NSNVLLLVGF
ILIFSTAGYY FWNRRN

EF094-3 (SEQ ID NO:359)
CGA TGAAATTACT
CACCCTCAAG AGGTAACAAT TCATTATGAC GTAAGTAAAC TGTATGAAGT TGACGGAACT
TTTAGCGATG GCAGCACGCT CTCAGAACGT ACTACGTCAT TATATGCAGA ATACAATGGT
GCAAAACAAA CAGTATTTTG TATTGAACCA GGTGTTAGTA TTCCAACAGA AGTGACGCAC
GGTTATCAGA AAAACCCTTT GCCATCAATG TCTGATAAAG CGAAACTAGT ATCGGTTCTT
TGGGAAAAGG CTGGAACAGA TATTGATACA AATATGGTTG CACAAAAGAT GATTTGGGAA
GAAGTGAACG GTTATAAACT CCATTCCATA AAAAGATTAG GTGGTGCTTC AGTTGATATA
AAATCTATTG AAGGAAAAAT TAATAAGGCA ATTGAGGAGT ATCAAAAAAA ACCAAGTTTT
CATAATACCA CTGTAAAAAC AATTTTAGGT CAATCGACAA CTTTAATAGA TAAAAATGAA
TTAAATTTAT CTGAGTTTGA TAAAGTCGTC CAAAATACGG CGAATATAGA TTACCGTGTA
ATTGGGAATC AATTAGTGCT TACTCCAAAC TCTAATTCCA AATCAGGAAC ATTAACATTG
AAAAAATCAG CTGGTACTGG AACTCCAGTC GCTTATAAAA AAGCAGGACT TCAAACTGTG
ATGGCTGGTG CGCTTGATAA GCCCAATACC TACGCTATTA AAATTAATGT GGAAACTAAG
GGTTCTTTAA AGATCAAAAA AATCGATAAA GAATCAGGTG ATATTGTACC AGAAACGGTT
TTCCATTTAG ATTTTGGGAA AGCTTTACCT TCAAAAGATG TGACAACAGA TAAAGATGGG
ATTTCTATTT TGGATGGAAT TCCCCATGGT ACAAAGGTAA CTATTACTGA AAAATCGGTG
CCAGATCCTT ATATGATTGA TACCACACCC ATGGCTGCCA CCATTAAAGC GGGCGAGACC
ATTTCCATGA CTTCGAAAAA TATGCGACAA AAAGGTCAAA TTCTTTTAGA GAAGACTGGG
GTAGAAACAG GTACTGATCT TTGGAATGAC AATTATTCTC TAGCTGGAAA TACATTTGCC
ATTCGTAAAG ACAGCCCAGC TGGTGAAATT GTCCAAGAAA TAACAACGGA TGAAAAAGGT
CGTGCGGAAA CACCAAAAGA GCTTGCTAAT GCTTTGGAAC TGGGAACCTA TTACGTGACA
GAAACTAAAT CTAGTAATGG TTTCGTGAAT ACCTTCAAAC CAACAAAAGT CGAGTTAAAA
TATGCCAATC AAACCGTGGC TCTTGTTACC AGTAACGTAA AAGGGCAAAA CCAAGAAATT
ACTGGGGAAA CCACTTTGAC AAAAGAAGAC AAAGATACCG GTAATGAGAG TCAAGGGAAA
GCTGAGTTTA AGGAGCTGA ATATACTCTC TTTACTGCAA AAGATGGTCA AGCTGTTAAA
TGGAGTGAAG CTTTTAAAAC AGAATTAGTG AAGGGAACGA AAGCTTCTGA TGAAACAG

TABLE 1-continued

Nucleotide and Amino Acid Seqeuences of *E. faecalis* Genes.

EF094-4 (SEQ ID NO:360)
DEITH
PQEVTIHYDV SKLYEVDGTF SDGSTLSERT TSLYAEYNGA KQTVFCIEPG VSIPTEVTHG
YQKNPLPSMS DKAKLVSVLW EKAGTDIDTN MVAQKMIWEE VNGYKLHSIK RLGGASVDIK
SIEGKINKAI EEYQKKPSFH NTTVKTILGQ STTLIDKNEL NLSEFDKVVQ NTANIDYRVI
GNQLVLTPNS NSKSGTLTLK KSAGTGTPVA YKKAGLQTVM AGALDKPNTY AIKINVETKG
SLKIKKIDKE SGDIVPETVF HLDFGKALPS KDVTTDKDGI SILDGIPHGT KVTITEKSVP
DPYMIDTTOM AATIKAGETI SMTSKNMRQK GQILLEKTGV ETGTDLWNDN YSLAGNTFAI
RKDSPAGEIV QEITTDEKGR AETPKELANA LELGTYYVTE TKSSNGFVNT FKPTKVELKY
ANQTVALVTS NVKGQNQEIT GETTLTKEDK DTGNESQGKA EFKGAEYTLF TAKDGQAVKW
SEAFKTELVK GTKASDET

EF095-1 (SEQ ID NO:361)
TAAGAATTGT TGGATTGTTC TTTAGAAAGA AGGGACAATA TGAAGCGAAG TAAATGGAAA
GAATTGATAG TAACGGGCAT CTGCCATATA TTAGTATTCC CCATACTAAT ACAGACAACT
GTTTTTGCAG AAACATTACC AAGTACAAAA CAAGTAAGAA AAGGAACCAA TCATTCATTA
ACAGCAGAAA AAGCCGAAAG TGAACAACCA CAGACAAAGG ATAAACTACA TGATGAAGAA
ACACTGGCAT TGTCAAAAAG TGAGTTAATC GATAATGAGG CTAATGTTAC AAGTCAAACG
ATTAGAGAAA GAATTGAGAC GCCTAACCTA ACTTATCGTT ATGGATTTAT TAATGAAGAG
GGGCAGCCAG TAAACGCCAA TGAGATCCTT CTACAGTATC ATAGTTGGCA AGGCAATTCC
CCAGATGGCA TAAATGTGTG GGAAGGTGAA AGTCAACCAG TGACAGCATG TACAGTGGCT
AATTTAAAAG AAGTGGTAAT TCCAAGTGAG AAAGTAGCCG TCTATTCCGA CATGTCAACG
GTGCTTGCAG CGAGTAATCA AACATTTTTT TTACCAAGAT ATTATACTTC TTTAAGCTTA
TACAATAAGA AAGGGGAAAT TGATCCCAAT TATCCGCTGC CAACTATTTC CGACGCATCA
GGAAACCAAT ATCCAACAAC AATTTCGCAA TTTGAATTGG AAAAAATGTC TGCACAACAA
TATAGTCAGA AAACAGGAGT AACGTTTAAC ATTAGCGAGA GTCAAAAACT AATCGTTCCT
TTGTACAACC AAGTGAAGGT TGATTCATCG AATCAATCTG GGCTATTGAA TTACTTTAAA
TTTTCAGGGC CGGTTTATTA TCATGTTACC AATCGCAAAG TGACAGAACA TTTTGTGGAT
ACTCAAGGGA AACCAATCCC TCCACCACCG GGGTTTAGAC AAGGAAAGCA AACACTTATT
GAGCGTGACC CTTACACCTT TAAACAGAAA GATCTTTTGC CAAGTAGCTA TGAAATTGAC
TCAAAAACGT ATCAATTTCA AGGATGGTAT AAAGGGAAAA CGAAACCTGA AAATTTAGAA
AAAAGCGTAA CGCCCAGTTA TGATATTACC TATGACGACA ATGATGATTT AACTGTTGTC
TATAAGGAGA TACCTCAAAA AAATTATACA TTTGAGGATG TCAATGGTGT TGAAATTGCA
CCACCATCTG ATTTTATTCA GGATCACCAA CAACCAATAA CTACGGATGG CTTTCGCTAT
TTAGCTGGAA AAAAACTGCC ACAACAATAC AGCGTTAACG GTAAAACTTA TTTATATCAA
GGTTGGTATC AAGATAAAAC NAAACAAGAG AGCTTAGAAA AAACGAAGCG ACCCATAAAC
TCCCCTGTTT TTAATGAAAT GAACGCTATT ACAGCAGTGT ATAAGGAAAT AACTGCAAAA
GCTGAAATGC AAATAGAAGG ACTAGTCAAA GTCATGCCAA GTGGTTATAT ACAAATTTGG
CAGATTATGC TTACAAATGT GGGAGAAGTA CCGTTAAAAA AATAAACTT AAAGCCAGCA
AGTGGTTGGT CACCAGGTCT AGCTCGGCCA ATCCAAGTCA CGATTCGTGT TGGATCTGAA
CCAAACAAAA TTGTTCCTAT TACTGATGAA AATTGGCAG TTGGCATTAC TTTAAATACG
GAAGTGCCTA TTGGTCAGAC AGCAACTATT ATGATGACAA CAATTGCTAC AGGTGAACCA
GATCAAGTGT TACAAGCGGC TGTTGAAATG AATGGAAATT TTTCTGCTGT TCACGCAGCT
GATACTGTCA GAATCCAACC TAAAAATCAA GAATTGTGG CACCAGATGA GGAAGGTTTT
ATCAGCACAC CAACTTTTGA TTTTGGCAAA GTCGCCATTT CTAGCAACAC GCAGCAACAT
GGTTTAAAGC AGGCAGCAGA TTATTATGAA AATGGTCAGG AAAATCCATA TTTACGTTTG
AAAAAATCAC AACCCAATTG GGCACTAACT GCAGAACTAT CCCCCTTTGA AGGAAGAGTG
GATCAACTAT CATCAATGAC AAAGTTATTG TTAGGAACAA CCAATGTTTC AGGTTTTATT
CAGTACAATG AACCAACGGA AACTAAAGTT GCTCTTGGCA AAACAACCGC TATTCAATTA
GTTGCCAACG GTGTAGCTAG CCATATTGTT GCCAATGGTC AGTTTGACGA AAGTGATGTT
TATCAATTTG ATTTTTCTTT TGATCAAATC AAATTAGAAA TTCCAGCAAA TCAAGGTAGA
AAAGATCAAA CTTATCAAGC AATGGTGACT TGGAATTTAG TGACAGGCCC ATAA

EF095-2 (SEQ ID NO:362)
MKRSKWKE LIVTGICHIL VFPILIQTTV FAETLPSTKQ VREGTNHSLT
AEKAESEQPQ TKDKLHDEET LALSKSELID NEANVTSQTI RERIETPNLT YRYGFINEEG
QPVNANEILL QYHSWQGNSP DGINVWEGES QPVTASTVAN LKEVVIPSEK VAVYSDMSTV
LAASNQTFFL PRYYTSLSLY NKKGEIDPNY PLPTISDASG NQYPTTISQF ELEKMSAQQY
SQKTGVTFNI SESQKLIVPL YNQVKVDSSN QSGLLNYFKF SGPVYYHVTN RKVTEHFVDT
QGKPIPPPPG FRQGKQTLIE RDPYTFKQKD LLPSSYEIDS KTYQFQGWYK GKTKPENLEK
SVTPSYDITY DDNDDLTVVY KEIPQKNYTF EDVNGVEIAP PSDFIQDHQQ PITTDGFRYL
AGKKLPQQYS VNGKTYLYQG WYQDKTKQES LEKTKRPINS PVFNEMNAIT AVYKEITAKA
EMQIEGLVKV MPSGYIQIWQ IMLTNVGEVP LKKINLKPAS GWSPGLARPI QVTIRVGSEP
NKIVPITDEN WRVGITLNTE VPIGQTATIM MTTIATGEPD QVLQAAVEMN GNFSAVHAAD
TVRIQPKNQE IVAPDEEGFI STPTFDFGKV AISSNTQQHG LKQAADYYEN GQENPYLRLK
KSQPNWALTA ELSPFEGRVD QLSSMTKLLL GTTNVSGFIQ YNQPTETKVA LGKTTAIQLV
ANGVASHIVA NGQFDESDVY QFDFSFDQIK LEIPANQGRK DQTYQAMVTW NLVTGP

EF095-3 (SEQ ID NO:363)
AAGTACAAAA CAAGTAAGAG AAGGAACCAA TCATTCATTA
ACAGCAGAAA AAGCCGAAAG TGAACAACCA CAGACAAAGG ATAAACTACA TGATGAAGAA
ACACTGGCAT TGTCAAAAAG TGAGTTAATC GATAATGAGG CTAATGTTAC AAGTCAAACG
ATTAGAGAAA GAATTGAGAC GCCTAACCTA ACTTATCGTT ATGGATTTAT TAATGAAGAG
GGGCAGCCAG TAAACGCCAA TGAGATCCTT CTACAGTATC ATAGTTGGCA AGGCAATTCC
CCAGATGGCA TAAATGTGTG GGAAGGTGAA AGTCAACCAG TGACAGCATC TACAGTGGCT
AATTTAAAAG AAGTGGTAAT TCCAAGTGAG AAAGTAGCCG TCTATTCCGA CATGTCAACG

TABLE 1-continued

Nucleotide and Amino Acid Seqeuences of *E. faecalis* Genes.

```
GTGCTTGCAG CGAGTAATCA AACATTTTTT TTACCAAGAT ATTATACTTC TTTAAGCTTA
TACAATAAGA AAGGGGAAAT TGATCCCAAT TATCCGCTGC CAACTATTTC CGACGCATCA
GGAAACCAAT ATCCAACAAC AATTTCGCAA TTTGAATTGG AAAAAATGTC TGCACAACAA
TATAGTCAGA AAACAGGAGT AACGTTTAAC ATTAGCGAGA GTCAAAAACT AATCGTTCCT
TTGTACAACC AAGTGAAGGT TGATTCATCG AATCAATCTG GGCTATTGAA TTACTTTAAA
TTTTCAGGGC CGGTTTATTA TCATGTTACC AATCGCAAAG TGACAGAACA TTTTGTGGAT
ACTCAAGGGA AACCAATCCC TCCACCACCG GGGTTTAGAC AAGGAAAGCA AACACTTATT
GAGCGTGACC CTTACACCTT TAAACAGAAA GATCTTTTGC CAAGTAGCTA TGAAATTGAC
TCAAAAACGT ATCAATTTCA AGGATGGTAT AAAGGGAACA CGAAACCTGA AAATTTAGAA
AAAAGCGTAA CGCCCAGTTA TGATATTACC TATGACGACA ATGATGATTT AACTGTTGTC
TATAAGGAGA TACCTCAAAA AAATTATACA TTTGAGGATG TCAATGGTGT TGAAATTGCA
CCACCATCTG ATTTTATTCA GGATCACCAA CAACCAATAA CTACGGATGG CTTTCGCTAT
TTAGCTGGAA AAAAACTGCC ACAACAATAC AGCGTTAACG GTAAAACTTA TTTATATCAA
GGTTGGTATC AAGATAAAAC NAAACAAGAG AGCTTAGAAA AAACGAAGCG ACCCATAAAC
TCCCCTGTTT TTAATGAAAT GAACGCTATT ACAGCAGTGT ATAAGGAAAT AACTGCAAAA
GCTGAAATGC AAATAGAAGG ACTAGTCAAA GTCATGCCAA GTGGTTATAT ACAAATTTGG
CAGATTATGC TTACAAATGT GGGAGAAGTA CCGTTAAAAA AAATAAACTT AAAGCCAGCA
AGTGGTTGGT CACCAGGTCT AGCTCGGCCA ATCCAAGTCA CGATTCGTGT TGGATCTGAA
CCAAACAAAA TTGTTCCTAT TACTGATGAA AATTGGCGAG TTGGCATTAC TTTAAATACG
GAAGTGCCTA TTGGTCAGAC AGCAAGTATT ATGTGATCAA CAATTGCTAC AGGTGAACCA
GATCAAGTGT TACAAGCGGC TGTTGAAATG AATGGAAATT TTTCTGCTGT TCACGCAGCT
GATACTGTCA GAATCCAACC TAAAAATCAA GAAATTGTGG CACCAGATGA GGAAGGTTTT
ATCAGCACAC CAACTTTTGA TTTTGGCAAA GTCGCCATTT CTAGCAACAC GCAGCAACAT
GGTTTAAAGC AGGCAGCAGA TTATTATGAA AATGGTCAGG AAAATCCATA TTTACGTTTG
AAAAAAATCAC AACCCAATTG GGCACTAACT GCAGAACTAT CCCCCTTTGA AGGAAGAGTG
GATCAACTAT CATCAATGAC AAAGTTATTG TTAGGAACAA CCAATGTTTC AGGTTTTATT
CAGTACAATC AACCAACGGA AACTAAAGTT GCTCTTGGCA AAACAACCGC TATTCAATTA
GTTGCCAACG GTGTAGCTAG CCATATTGTT GCCAATGGTC AGTTTGACGA AAGTGATGTT
TATCAATTTG ATTTTTCTTT TGATCAAATC AAATTAGAAA TTCCAGCAAA TCAAGGTAGA
AAAGATCAAA CTTATCAAGC AATGGTGACT TGGAATTTAG TGACAGGCCC A

EF095-4 (SEQ ID NO:364)
STKQ VREGTNHSLT
AEKAESEQPQ TKDKLHDEET LALSKSELID NEANVTSQTI RERIETEPNLT YRYGFINEEG
QPVNANEILL QYHSWQGNSP DGINVWEGES QPVTASTVAN LKEVVIPSEK VAVYSDMSTV
LAASNQTFFL PRYYTSLSLY NKKGEIDPNY PLPTISDASG NQYPTTISQF ELEKMSAQQY
SQKTGVTFNI SESQKLIVPL YNQVKVDSSN QSGLLNYFKF SGPVYYHVTN RKVTEHFVDT
QGKPIPPPPG FRQGKQTLIE RDPYTFKQKD LLPSSYEIDS KTYQFQGWYK GKTKPENLEK
SVTPSYDITY DDNDDLTVVY KEIPQKNYTF EDVNGVEIAP PSDFIQDHQQ PITTDGFRYL
AGKKLPQQYS VNGKTYLYQG WYQDKTKQES LEKTKRPINS PVFNEMNAIT AVYKEITAKA
EMQIEGLVKV MPSGYIQIWQ IMLTNVGEVP LKKINLKPAS GWSPGLARPI QVTIRVGSEP
NKIVPITDEN WRVGITLNTE VPIGQTATIM MTTIATGEPD QVLQAAVEMN GNFSAVHAAD
TVRIQPKNQE IVAPDEEGFI STPTFDFGKV AISSNTQQHG LKQAADYYEN GQENPYLRLK
KSQPNWALTA ELSPFEGRVD QLSSMTKLLL GTTNVSGFIQ YNQPTETKVA LGKTTAIQLV
ANGVASHIVA NGQFDESDVY QFDFSFDQIK LEIPANQGRK DQTYQAMVTW NLVTGP

EF096-1 (SEQ ID NO:365)
TGAGGTGGCC AAGTTAAAAT GAAAAAATTA CAGTCACTTT TTATTGGAAT TATCGCTATT
ATTGTCATCT TGTTTTTTGG CGTGCGCCAA TTGGAGAAAG CAAGTGGCAT GGCAGGAGCA
GATACCTTGA CCATTTACAA TTGGGGGGAC TATATAGATC CGGCCTTGAT TAAGAAATTT
GAAAAAGAAA CAGGCTATAA AGTCAATTAC GAAACCTTTG ATTCTAATGA AGCTATGTAT
ACAAAAATTC AGCAAGGTGG CACAGCCTAT GATATTGCCA TTCCTTCTGA ATATATGATT
CAAAAAATGA TGAAAGCGAA GATGCTTTTA CCACTTGATC ACAGCAAATT AAAAGGCTTA
GAAAACATTG ATGCACGCTT TTTAGATCAA TCCTTTGATC CAAAAATAA GTTTTCCGTT
CCGTACTTCT GGGGCACGTT GGGGATTATT TATAATGATA AATTTATTGA CGGCCGTCAG
ATCCAACATT GGGATGATTT ATGGCGCCCG GAATTAAAAA ATAATGTCAT GCTGATTGAT
GGCGCTCGCG AAGTGTTAGG ATTATCTTTG AACAGTTTAG GCTATTCGTT AAACAGTAAA
AACGACCAAC AATTACGTCA GGCTACCGAT AAGTTAAACC GATTAACGAA CAATGTCAAA
GCAATTGTTG CCGATGAAAT CAAAATGTAC ATGGCTAATG AAGAAAGTGC AGTTGCTGTA
ACTTTCTCTG GTGAAGCTGC TGAAATGCTA GAAAACAATG AACATCTACA TTATGTGATT
CCCAGTGAAG GCTCTAATCT CTGGTTTGAT AACATTGTGA TGCCTAAGAC AGCCAAAAAT
AAAGAGGGTG CCTATGCATT TATGAACTTT ATGTTACGAC CAGAAAATGC GGCACAAAAT
GCAGAATATA TTGGTTATTC CACACCAAAT AAAGAAGCTA AAAAACTATT ACCAAAAGAA
GTTGCCGAAG ATAAACAATT TTATCCAGAT GATGAAACTA TCAAACATTT AGAAGTTTAC
CAAGACTTAG GTCAAGAATA CTTAGGAATT TATAACGATC TGTTCTTGGA GTTTAAGATG
TATCGGAAAT AA

EF096-2 (SEQ ID NO:366)
MKKLQ SLFIGIIAII VILFFGVRQL EKASGMAGAD TLTIYNWGDY IDPALIKKFE
KETGYKVNYE TFDSNEAMYT KIQQGGTAYD IAIPSEYMIQ KMMKAKMLLP LDHSKLKGLE
NIDARFLDQS FDPKNKFSVP YFWGTLGIIY NDKFIDGRQI QHWDDLWRPE LKNNVMLIDG
AREVLGLSLN SLGYSLNSKN DQQLRQATDK LNRLTNNVKA IVADEIKMYM ANEESAVAVT
FSGEAAEMLE NNEHLHYVIP SEGSNLWFDN IVMPKTAKNK EGAYAFMNFM LRPENAAQNA
EYIGYSTPNK EAKKLLPKEV AEDKQFYPDD ETIKHLEVYQ DLGQEYLGIY NDLFLEFKMY
RK

EF096-3 (SEQ ID NO:367)
```

TABLE 1-continued

Nucleotide and Amino Acid Seqeuences of E. faecalis Genes.

```
AAGTGGCAT GGCAGGAGCA
GATACCTTGA CCATTTACAA TTGGGGGGAC TATATAGATC CGGCCTTGAT TAAGAAATTT
GAAAAAGAAA CAGGCTATAA AGTCAATTAC GAAACCTTTG ATTCTAATGA AGCTATGTAT
ACAAAAATTC AGCAAGGTGG CACAGCCTAT GATATTGCCA TTCCTTCTGA ATATATGATT
CAAAAAATGA TGAAAGCGAA GATGCTTTTA CCACTTGATC ACAGCAAATT AAAAGGCTTA
GAAAACATTG ATGCACGCTT TTTAGATCAA TCCTTTGATC CCAAAAATAA GTTTTCCGTT
CCGTACTTCT GGGGCACGTT GGGGATTATT TATAATGATA AATTTATTGA CGGCCGTCAG
ATCCAACATT GGGATGATTT ATGGCGCCCG GAATTAAAAA ATAATGTCAT GCTGATTGAT
GGCGCTCGCG AAGTGTTAGG ATTATCTTTG AACAGTTTAG GCTATTCGTT AAACAGTAAA
AACGACCAAC AATTACGTCA GGCTACCGAT AAGTTAAACC GATTAACGAA CAATGTCAAA
GCAATTGTTG CCGATGAAAT CAAAATGTAC ATGGCTAATG AAGAAAGTGC AGTTGCTGTA
ACTTTCTCTG GTGAAGCTGC TGAAATGCTA GAAAACAATG AACATCTACA TTATGTGATT
CCCAGTGAAG GCTCTAATCT CTGGTTTGAT AACATTGTGA TGCCATTGAC AGCCAAAAAT
AAAGAGGGTG CCTATGCATT TATGAACTTT ATGTTACGAC AGAAAATGC GGCACAAAAT
GCAGAATATA TTGGTTATTC CACACCAAAT AAAGAAGCTA AAAAACTATT ACCAAAAGAA
GTTGCCGAAG ATAAACAATT TTATCCAGAT GATGAAACTA TCAAACATTT AGAAGTTTAC
CAAGACTTAG GTCAAGAATA CTTAGGAATT TATAACGATC TGTTCTTGGA GTTTAAGATG
TATCGGAAA

EF096-4 (SEQ ID NO:368)
SGMAGAD TLTIYWGDY IDPALIKKFE
KETGYKVNYE TFDSNEAMYT KIQQGGTAYD IAIPSEYMIQ KMMKAKMLLP LDHSKLKGLE
NIDARFLDQS FDPKNKFSVP YFWGTLGIIY NDKFIDGRQI QHWDDLWRPE LKNNVMLIDG
AREVLGLSLN SLGYSLNSKN DQQLRQATDK LNRLTNNVKA IVADEIKMYM ANEESAVAVT
FSGEAAEMLE NNEHLHYVIP SEGSNLWFDN IVMPKTAKNK EGAYAFMNFM LRPENAAQNA
EYIGYSTPNK EAKKLLPKEV AEDKQFYPDD ETIKHLEVYQ DLGQEYLGIY NDLFLEFKMY
RK

EF097-1 (SEQ ID NO:369)
TAGAAGTATT CTAATTATCT ACATAGAGAG CGAGGGACAA GGAATATGAA GGAAAAAGAA
ATGCATTCGC TCTTTTTTAA ACATAAGTTT GTGAAAGTAA CACCCTATTT ACGTCGTTTT
GGTCATCGTT TGAGTGGGAT GATTATGCCA AATTTGAGTA TTTTTATTGC GTGGAGCTTA
TTGTCTTTGG TGGCTGGCTA TACGACTGGG AATCTACGGC TAGCTCTTTC TGAAGTCGAA
ACGATAATGA TTCGAGTTGT TTTACCGATT CTAATTGGTT TTACAGGCGG AAAAATGTTC
GAGGAACAAC GTGGCGGCGT TGTTGCTGCT ATTGCGACAG TGGGCGTGAT TGTTTCCACA
GATGTTCCAC AGTTGTTTGG TGCTATGTTT ATTGGCCCTT TAGCAGGATA TACTTTCGCC
AAAATTGAAC AAATTCTCTT ACCGAAAGTT AAAGAAGGCT ACGAGATGCT GACTAAAAAC
TTTTTAGCAG GAATTGTGGG AGGACTGCTG TGCTGTTTTG GTATTCTGGT TGTAGCTCCG
GCTGTTGAAA GCGCTAGTTT TTGGCTGTAT CAATTTTCTT CTTGGTTAAT TGAAGCCAAT
CTTTTACCAT TGGTTCACGT TTTCTTAGAG CCCTTAAAAG TGTTATTTTT TAATAATGCG
ATTAACCATG GCTTATTAAC GCCTCTAGGT TTAGAAGGTG CTAGTCAAAC AGGTCAGTCC
ATTTTATTTC TATTGGAAAC AAACCCTGGA CCAGGCGTGG GCGTTTTGGT TGCTTTTCTG
CTGTTTGGGC CTGTAGGACA ACGAAAAACA GCAGGAGGTG CCACCATGAT TCAACTGATT
GGGGGCATTC ATGAAATTTA TTTTCCGTTT GTTTTGATGG ACCCGCGCTT ATTTTTAGCA
GTAATTGCTG GAGGAATGAG TGGTACGCTT GTTTTTCAAA TATTTAATGT GGGTCTAAGT
GCTCCAGCTT CGCCAGGTTC ATTGGTTGCG ATTTTAGCCA ATGCCCCGAC TGATGCGAGG
CTGGCGGTTT TTAGCGGAAT TTTTGTTAGC TTTCTGTGCT CTTTTGCAAT AGCAAGCTTG
TTATTAAAAC GTCAACGAGG AATTGAACCA GTTTCAATGA TAAAGATGAA GGAGGAAGAC
CAAGTGGAAA CAGTCACACC TAACTCTACG CAAATTTTAT TTGTTTGTGA TGCAGGAATG
GGCTCAAGTG CCATGGGGGC TAGTTTGCTA AGCCGACAAT TAAAAGCTGT GAACTTGGAG
ATGCCTGTGA CTTACCAGTC CGTTCATCAG ATGAAGTGGC AGCCTAAGAC ATTAGTGGTC
ATTCAAGCAG AATTGAAACA GTTAGCACAA AAGTACGTCC CAGAAAAGGA TATGGTGAGT
GTTCAAAATT TTTTAGAAAT TAAATCCTAT TACCCGCAAG TTTTAGCCAA ACTGACTGCT
TCTTCTCAAG AGCAATCTTC ACTTGGTTCA GAGTCTACTG AAACGAACTC GACAAAACAA
ATACAGAAGC TTCTTTTTTT ATATGCCGAG AATGTTCGAG GATCGCAAAC AATGGGAATG
GAATTATTGC GGCAACAAGC GGCGAAACAA GGAGTCGCGA TTGAAGTATC TAAAGAGCCA
CTGGAAACAG TCTTTTTTAC CAAGGAGACA ACCTACGTAG TGACTCGTGA ACTGGCGCAA
GCCTATCATT TAGATCTAAC GCAAGAAAAT TTATACGTAG TTACTAGTTT TTTGAATAAG
AAAGAGTATC AAGAATGGCT GGAAGGAGGA GCTGATAGAT GTTTTTAA

EF097-2 (SEQ ID NO:370)
MLTKNF LAGIVGGLLC CFGILVVAPA
VESASFWLYQ FSSWLIEANL LPLVHVFLEP LKVLFFNNAI NHGLLTPLGL EGASQTGQSI
LFLLETNPGP GVGVLVAFLL FGPVGQRKTA GGATMIQLIG GIHEIYFPFV LMDPRLFLAV
IAGGMSGTLV FQIFNVGLSA PASPGSLVAI LANAPTDARL AVFSGIFVSF LCSFAIASLL
LKRQRGIEPV SMIKMKEEDQ VETVTPNYQQ ILFVCDAGMG SSAMGASLLS RQLKAVNLEM
PVTYQSVHQM KWQPKTLVVI QAELKQLAQK YVPEKDMVSV QNFLEIKSYY PQVLAKLTAS
SQEQSSLGSE STETNSTKQI QKLVFLYAEN VRGSQTMGME LLRQQAAKQG VAIEVSKEPL
ETVFFTKETT YVVTRELAQA YHLDLTQQNL YVVTSFLNKK EYQEWLEGGA DRCF

EF097-3 (SEQ ID NO:371)
ACGAGG AATTGAACCA GTTTCAATGA TAAAGATGAA GGAGGAAGAC
CAAGTGGAAA CAGTCACACC TAACTCTACG CAAATTTTAT TTGTTTGTGA TGCAGGAATG
GGCTCAAGTG CCATGGGGGC TAGTTTGCTA AGCCGACAAT TAAAAGCTGT GAACTTGGAG
ATGCCTGTGA CTTACCAGTC CGTTCATCAG ATGAAGTGGC AGCCTAAGAC ATTAGTGGTC
ATTCAAGCAG AATTGAAACA GTTAGCACAA AAGTACGTCC CAGAAAAGGA TATGGTGAGT
GTTCAAAATT TTTTAGAAAT TAAATCCTAT TACCCGCAAG TTTTAGCCAA ACTGACTGCT
```

TABLE 1-continued

Nucleotide and Amino Acid Seqeuences of E. faecalis Genes.

```
TCTTCTCAAG AGCAATCTTC ACTTGGTTCA GAGTCTACTG AAACGAACTC GACAAAACAA
ATACAGAAGC TTGTTTTTTT ATATGCCGAG AATGTTCGAG GATCGCAAAC AATGGGAATG
GAATTATTGC GGCAACAAGC GGCGAAACAA GGAGTCGCGA TTGAAGTATC TAAAGAGCCA
CTGGAAACAG TCTTTTTTAC CAAGGAGACA ACCTACGTAG TGACTCGTGA ACTGGCGCAA
GCCTATCATT TAGATCTAAC GCAACAAAAT TTATACGTAG TTACTAGTTT TTTGAATAAG
AAAGAGTATC AAGAATGGCT GGAAGGAGGA GCTGATAGAT GTTTTT
```

EF097-4 (SEQ ID NO:372)
RGIEPV SMIKMKEEDQ VETVTPNYQQ ILFVCDAGMG SSAMGASLLS RQLKAVNLEM
PVTYQSVHQM KWQPKTLVVI QAELKQLAQK YVPEKDMVSV QNFLEIKSYY PQVLAKLTAS
SQEQSSLGSE STETNSTKQI QKLVFLYAEN VRGSQTMGME LLRQQAAKQG VAIEVSKEPL
ETVFFTKETT YVVTRELAQA YHLDLTQQNL YVVTSFLNKK EYQEWLEGGA DRCF

EF098-1 (SEQ ID NO:373)
```
TAAATGAAAA AGACAAAAGT AATGACATTG ATGGCAACCA CAACTTTAGG CGCACTGGCA
CTTGTACCAA TGAGTGCATT AGCAGTCGAC GGTGGTGAAT ACCAAACAAA CGGAGCGATT
CAATTTGCAC CAAATACGAA CCCAACGAAT CCAGTTGATC CGACGAATCC AGACCCAGAT
AAACCAATTA CACCAGTTGA TCCAACTGAT CCGACAGGGC CTAAGCCAGG GACAGCAGGT
CCGTTATCCA TTGACTATGC ATCTAGCTTA TCTTTTGGGG AACAAACGAT TACCTCAAAA
AATATGACCT ACTATGCAGA AACACAAAAA TACAAAGATA ACGCTGGTGC CGACCAAGAA
GGCCCAAACT TTGTTCAAGT CTCAGATAAT CGTGGGACTG AGACAGGTTG GACGCTAAAA
GTAAAACAAA ATGGTCAATT CAAAACTGAA GCCAACCAAG AACTAACAGC GGCCAAAGTA
ACTTTAAGCA ACGGACGCGT GGTTTCAGCT TCACAATCTG CAAAGCCAAC GACAGCGCCA
GCTACGATTG AATTAAACCC AACTGGGGCT GAATCAGTGG TCATGGCTGC TGGCGATAAA
GAAGGTGCGG GTACGTACTT AATGAGCTGG GGCGATAGTG TAGATACCGC TAAAACAAGT
ATTTCATTAG AAGTACCTGG TTCAACCACA AAATATGCGA AAAAATACAC GACAACTTTT
ACTTGGACTT TGACAGATAC ACCTGCTAAC ACAGGAAACT AA
```

EF098-2 (SEQ ID NO:374)
MKKTKVMTLM ATTTLGALAL VPMSALAVDG GEYQTNGAIQ FAPNTNPTNP VDPTNPDPDK
PITPVDPTDP TGPKPGTAGP LSIDYASSLS FGEQTITSKN MTYYAETQKY KDNAGADQEG
PNFVQVSDNR GTETGWTLKV KQNGQFKTEA NQELTAAKVT LSNGRVVSAS QSAKPTTAPA
TIELNPTGAE SVVMAAGDKE GAGTYLMSWG DSVDTAKTSI SLEVPGSTTK YAKKYTTTFT
WTLTDTPANT GN

EF098-3 (SEQ ID NO:375)
```
AGTCGAC GGTGGTGAAT ACCAAACAAA CGGAGCGATT
CAATTTGCAC CAAATACGAA CCCAACGAAT CCAGTTGATC CGACGAATCC AGACCCAGAT
AAACCAATTA CACCAGTTGA TCCAACTGAT CCGACAGGGC CTAAGCCAGG GACAGCAGGT
CCGTTATCCA TTGACTATGC ATCTAGCTTA TCTTTTGGGG AACAAACGAT TACCTCAAAA
AATATGACCT ACTATGCAGA AACACAAAAA TACAAAGATA ACGCTGGTGC CGACCAAGAA
GGCCCAAACT TTGTTCAAGT CTCAGATAAT CGAGGGACTG AGACAGGTTG GACGCTAAAA
GTAAAACAAA ATGGTCAATT CAAAACTGAA GCCAACCAAG AACTAACAGC GGCCAAAGTA
ACTTTAAGCA ACGGACGCGT GGTTTCAGCT TCACAATCTG CAAAGCCAAC GACAGCGCCA
GCTACGATTG AATTAAACCC AACTGGGGCT GAATCAGTGG TCATGGCTGC TGGCGATAAA
GAAGGTGCGG GTACGTACAA AATGAGCTGG GGCGATAGTG TAGATACCGC TAAAACAAGT
ATTTCATTAG AAGTACCTGG TTCAACCACA AAATATGCGA AAAAATACAC GACAACTTTT
ACTTGGACTT TGACAGATAC ACCTGCTAAC ACAGGAAACT
```

EF098-4 (SEQ ID NO:376)
VDG GEYQTNGAIQ FAPNTNPTNP VDPTNPDPDK
PITPVDPTDP TGPKPGTAGP LSIDYASSLS FGEQTITSKN MTYYAETQKY KDNAGADQEG
PNFVQVSDNR GTETGWTLKV KQNGQFKTEA NQELTAAKVT LSNGRVVSAS QSAKPTTAPA
TIELNPTGAE SVVMAAGDKE GAGTYLMSWG DSVDTAKTSI SLEVPGSTTK YAKKYTTTFT
WTLTDTPANT GN

EF099-1 (SEQ ID NO:377)
```
TGATGTTGTA GAGGGCTGAT GAAATGTTTA TCAGTCTTCT TTTTATTGAA AGGAGAGATC
ATGAAGAAAT TAGGCAAGGT TTTAATTGTT AGTTGTTTTA TTTTTATTCT TCCTTTTTTA
TTATTTTTAG GTGTATTTTC TTCTAGTGAA AGCGGAGATT CTTCCCAGTT TCAGCCCGCT
ACACCACAGG AAAAAGTAGC ATTAGAAGTT TCTAACTACG TGACGTCACA TGGCGGAACG
TTGCAGTTTG CTTCCGCTTG GATTGGCAAT ATGGAACATG AAAGTGGATT AAATCCTGCT
AGAATTCAAA GTGATTTATC GTTTAATTCA GCGATAGCTT TTAATCCTTC GTTAGGCAGT
TATGGAATTG GGTTAGGACA ATGGGATTCA GGACGAAGAG TTAATTTATT AAATTTTGCA
AAAAGTCAAA AAAAGGAATG GAAATCAGTA GCTTTACAAA TGGATTTTGC GTGGAATAAG
GATGGTTCTG ATAGTGACTT ACTTAAAAGA ATGTCTAAAT CAAAAGATGT GAATACACTT
GCGGTAGATA TTTTGAAGCT GTGGGAACGA GCTGGAACAA AAGATGATCC CGCAGAACAA
GTAAAAAGAA AGGCTAGTGC TAATAATTGG TATAAACGAC TTTCTACAGG TTCCATGGGC
GGAGGTTCAG CCAATGTTGG TGGAGGAAAA ATTGATGCCT TGGAAAAAGT GATGGGGCAA
ACTATTAATG GTGGTCAATG TTATGGCTTA TCTGCTTTTT TTGTTGAAAA ACAAGGAGGT
CTACAAATGA TGGGTACGGG GCATATGTTT GCGAGTGAAA TTGGTAATGA TTATCCTTGG
AGTTCAATTG GTTGGACAGT ACTAAAGAAT CCAAATTATT CAGATATTAA AGCAGGAGAT
GTCATTAATT TTGGTCAAGG TGGTGTGGCT ACTAGTATTT ATGGGCATAC TGGTGTAGTG
GCAAGTGTTG AAGGTAAAAA CAAGTTTACT ACTTATGAGC AAAACGCTGA ACAAGGTCAA
ATTGTTGCTA AGTATTTTCG GACTTGGGGA TTAGATTTTC CACATGTGAC CAGCATAGTA
AGGAAATAG
```

TABLE 1-continued

Nucleotide and Amino Acid Seqeuences of E. faecalis Genes.

EF099-2 (SEQ ID NO:378)
MKCLS VFFLLKGEIM KKLGKVLIVS CFIFILPFLL FLGVFSSSES GDSSQFQPAT
PQEKVALEVS NYVTSHGGTL QFASAWIGNM EHESGLNPAR IQSDLSFNSA IAFNPSLGGY
GIGLGQWDSG RRVNLLNFAK SQKKEWKSVA LQMDFAWNKD GSDSDLLKRM SKSKDVNTLA
VDILKLWERA GTKDDPAEQV KRKASANNWY KRLSTGSMGG GSANVGGGKI DALEKVMGQT
INGGQCYGLS AFFVEKQGGL QMMGTGHMFA SEIGNDYPWS SIGWTVIKNP NYSDIKAGDV
INFGQGGVAT SIYGHTGVVA SVEGKNKFTT YEQNAEQGQI VAKYFRTWGL DFPHVTSIVR
K

EF099-3 (SEQ ID NO:379)
TAGTGAA AGCGGAGATT CTTCCCAGTT TCAGCCCGCT
ACACCACAGG AAAAAGTAGC ATTAGAAGTT TCTAACTACG TGACGTCACA TGGCGGAACG
TTGCAGTTTG CTTCCGCTTG GATTGGCAAT ATGGAACATG AAAGTGGATT AAATCCTGCT
AGAATTCAAA GTGATTTATC GTTTAATTCA GCGATAGCTT TTAATCCTTC GTTAGGCGGT
TATGGAATTG GGTTAGGACA ATGGGATTCA GGACGAAGAG TTAATTTATT AAATTTTGCA
AAAAGTCAAA AAAAGGAATG GAAATCAGTA GCTTTACAAA TGGATTTTGC GTGGAATAAG
GATGGTTCTG ATAGTGACTT ACTTAAAAGA ATGTCTAAAT CAAAAGATGT GAATACACTT
GCGGTAGATA TTTTGAAGCT GTGGGAACGA GCTGGAACAA AAGATGATCC CGCAGAACAA
GTAAAAGAA AGGCTAGTGC TAATAATTGG TATAAACGAC TTTCTACAGG TTCCATGGGC
GGAGGTTCAG CCAATGTTGG TGGAGGAAAA ATTGATGCCT TGGAAAAAGT GATGGGGCAA
ACTATTAATG GTGGTCAATG TTATGGCTTA TCTGCTTTTT TTGTTGAAAA ACAAGGAGGT
CTACAAATGA TGGGTACGGG GCATATGTTT GCGAGTGAAA TTGGTAATGA TTATCCTTGG
AGTTCAATTG GTTGGACAGT CATAAAGAAT CCAAATTATT CAGATATTAA AGCAGGAGAT
GTCATTAATT TTGGTCAAGG TGGTGTGGCT ACTAGTATTT ATGGGCATAC TGGTGTAGTG
GCAAGTGTTG AAGGTAAAAA CAAGTTTACT ACTTATGAGC AAAACGCTGA ACAAGGTCAA
ATTGTTGCTA AGTATTTTCG GACTTGGGGA TTAGATTTTC CACATGTGAC CAGCATAGTA
AGGAAAT

EF099-4 (SEQ ID NO:380)
SES GDSSQFQPAT
PQEKVALEVS NYVTSHGGTL QFASAWIGNM EHESGLNPAR IQSDLSFNSA IAFNPSLGGY
GIGLGQWDSG RRVNLLNFAK SQKKEWKSVA LQMDFAWNKD GSDSDLLKRM SKSKDVNTLA
VDILKLWERA GTKDDPAEQV KRKASANNWY KRLSTGSMGG GSANVGGGKI DALEKVMGQT
INGGQCYGLS AFFVEKQGGL QMMGTGHMFA SEIGNDYPWS SIGWTVIKNP NYSDIKAGDV
INFGQGGVAT SIYGHTGVVA SVEGKNKFTT YEQNAEQGQI VAKYFRTWGL DFPHVTSIVR
K

EF100-1 (SEQ ID NO:381)
TANTTATGGC AATATGGAAG GAGTTTTATA ATGAAAAAGA AACAAAAATA CGCAGGGTTT
ACATTATTAG AAATGTTGAT TGTCTTATTG ATTATTTCCG TATTGATTTT ACTTTTTGTC
CCTAACTTAG CGAAACATAA AGAAACAGTT GATAAAAAAG GCAATGAAGC AATCGTAAAA
ATTGTAGAAT CACAAATCGA GCTCTACACA CTAGAAAAAA ATAAGACGCC TTCCTTAAAT
GAATTAGTCA ACGAAGGCTA CATTACTAAA GAGCAGTTAG ATAAATATAC AGCAGAAAAG
CAATGA

EF100-2 (SEQ ID NO:382)
MKKKQKYAGF TLLEMLIVLL IISVLILLFV PNLAKHKETV DKKGNEAIVK
IVESQIELYT LEKNKTPSLN ELVNEGYITK EQLDKYTAEK Q

EF100-3 (SEQ ID NO:383)
TAA AGAAACAGTT GATAAAAAAG GCAATGAAGC AATCGTAAAA
ATTGTAGAAT CACAAATCGA GCTCTACACA CTAGAAAAAA ATAAGACGCC TTCCTTAAAT
GAATTAGTCA ACGAAGGCTA CATTACTAAA GAGCAGTTAG ATAAATATAC AGCAGAAAAG
CAAT

EF100-4 (SEQ ID NO:384)
KETV DKKGNEAIVK
IVESQIELYT LEKNKTPSLN ELVNEGYITK EQLDKYTAEK Q

EF100-1 (SEQ ID NO:385)
TANTTATGGC AATATGGAAG GAGTTTTATA ATGAAAAAGA AACAAAAATA CGCAGGGTTT
ACATTATTAG AAATGTTGAT TGTCTTATTG ATTATTTCCG TATTGATTTT ACTTTTTGTC
CCTAACTTAG CGAAACATAA AGAAACAGTT GATAAAAAAG GCAATGAAGC AATCGTAAAA
ATTGTAGAAT CACAAATCGA GCTCTACACA CTAGAAAAAA ATAAGACGCC TTCCTTAAAT
GAATTAGTCA ACGAAGGCTA CATTACTAAA GAGCAGTTAG ATAAATATAC AGCAGAAAAG
CAATGA

EF100-2 (SEQ ID NO:386)
MKKKQKYAGF TLLEMLIVLL IISVLILLFV PNAKHKETV DKK GNEAIVK
IVESQIELYT LEKNKTPSLN ELVNEGYITK EQLDKYTAEK Q

EF100-3 (SEQ ID NO:387)
TAA AGAAACAGTT GATAAAAAAG GCAATGAAGC AATCGTAAAA
ATTGTAGAAT CACAAATCGA GCTCTACACA CTAGAAAAAA ATAAGACGCC TTCCTTAAAT
GAATTAGTCA ACGAAGGCTA CATTACTAAA GAGCAGTTAG ATAAATATAC AGCAGAAAAG
CAAT

TABLE 1-continued

Nucleotide and Amino Acid Seqeuences of E. faecalis Genes.

EF100-4 (SEQ ID NO:388)
KETV DKKGNEAIVK
IVESQIELYT LEKNKTPSLN ELVNEGYITK EQLDKYTAEK Q

EF101-1 (SEQ ID NO:389)
TGAGGAGATG AAACGAAGAA AATGAAGAAG AAAACGATAA TTATATTGGG GGCAGTTGCG
GTAATTGCGG TTGGGGGCAT CGTAACTGTG AATGCGTTAA ATAAAAATGC ACAACAAGTA
GCTGTCAAGC AAGCGCCTAA AGATGACTGG GGAATTGACT ATTTTGACGT TCCCGACTTG
CAACAAATTT ATATTAACGG TGTCATCCAA CCGGAACAAA TGGAAGCCTT TGCGCGTGAT
CAAAAAATAA CAAAGGATCC AGAGATTAAG GTGAAAAACG GCGATGTCGT AGATGCAGGC
ACAGAATTAT TTACTTATGA AGATGAGGCG GTCACAAAAG AAATTGAGGC ACAACAAAAT
AGCTTAGCCA AATTAGAAAC GAAGCGGGCG AATATCTATA ATAAGTGGAA TCGGGCCATT
GATAAATTTA ATAAAACTAA AGAAGAAGAC CGCACGATGT CTGGTGATGA TTTAAATGAA
CAATATCAAA CAGAAGTCGA TGCAGTAGAT GAAGAGATTA CCTTCACCAA TGAAACCTTA
GCGGATTTAG GAGCGAAGCA ATATATTTCC ACAAAGGCTA ATTTCAAAGG TCGTGTATCA
ATTCCAGAAG TAAAAGATGC CAATTCACCG ATTTTACGGT TAACTTCAGA AGATCTTTAT
TTAGCTGGAA AAGTGAATGA AAAGGACTTG ACTAAAATTA GTGTTGGGCA AAAAGCTAAA
CTAACTTCTG TTTCCAACAA TGTGGTTGTG GATGGCTCAA TTTCTTACAT CGATGATAAT
CCTCCTGAAG GCAACAGCGA TGCCGCGAGT GGCAATCCAG AGGGCGGCAC AACGATGTCT
AGTTATAGCG TCAAAATTGC GTTGGCCAAT TTAGACAAAG TGAAAAATGG CTACCATATG
CAAGCAACCA TTGATTTAGG CGATTTAGGG GCGATTAAGT TACCGAAAAA AGCGATTCAA
AAAGAGGGTG AACAGGCCTA CGTTTTAGTG AATGATTTTG GAACCATCAT TCGTCGTGAT
GTCCAAGTCG GCAAGAAAA TGGCGACAAA ATGGCGATTG AATCTGGCTT AGAATCAGCC
GACCGAGTGG TTATTTCTTC AAAAAAACCA GTAAAGTCG GTGATATTGT TGAATCAGAT
GCAGCGATTG CTTCTGATGA ATCAGCAACC AACGAATCAA TGACAGATGC GTCGAAATAG

EF101-2 (SEQ ID NO:390)
MKKK TIIILGAVAV IAVGGIVTVN ALNKNAQQVA VKQAPKDDWG IDYFDVPDLQ
QIYINGVIQP EQMEAFARDQ KITKDPEIKV KNGDVVDAGT ELFTYEDEAV TKEIEAQQNS
LAKLETKRAN IYNKWNRAID KFNKTKEEDR TMSGDDLNEQ YQTEVDAVDE EITFTNETLA
DLGAKQYIST KANFKGRVSI PEVKDANSPI LRLTSEDLYL AGKVNEKDLT KISVGQKAKL
TSVSNNVVVD GSISYIDDNP PEGNSDAASG NPEGGTTMSS YSVKIALANL DKVKNGYHMQ
ATIDLGDLGA IELPKKAIQK EGEQAYVLVN DFGTIIRRDV QVGQENGDKM AIESGLESAD
RVVISSKKPV KVGDIVESDA AIASDESATN ESMTDASK

EF101-3 (SEQ ID NO:391)
TAAAAATGC ACAACAAGTA
GCTGTCAAGC AAGCGCCTAA AGATGACTGG GGAATTGACT ATTTTGACGT TCCCGACTTG
CAACAAATTT ATATTAACGG TGTCATCCAA CCGGAACAAA TGGAAGCCTT TGCGCGTGAT
CAAAAAATAA CAAAGGATCC AGAGATTAAG GTGAAAAACG GCGATGTCGT AGATGCAGGC
ACAGAATTAT TTACTTATGA AGATGAGGCG GTCACAAAAG AAATTGAGGC ACAACAAAAT
AGCTTAGCCA AATTAGAAAC GAAGCGGGCG AATATCTATA ATAAGTGGAA TCGGGCCATT
GATAAATTTA ATAAAACTAA AGAAGAAGAC CGCACGATGT CTGGTGATGA TTTAAATGAA
CAATATCAAA CAGAAGTCGA TGCAGTAGAT GAAGAGATTA CCTTCACCAA TGAAACCTTA
GCGGATTTAG GAGCGAAGCA ATATATTTCC ACAAAGGCTA ATTTCAAAGG TCGTGTATCA
ATTCCAGAAG TAAAAGATGC CAATTCACCG ATTTTACGGT TAACTTCAGA AGATCTTTAT
TTAGCTGGAA AAGTGAATGA AAAGGACTTG ACTAAAATTA GTGTTGGGCA AAAAGCTAAA
CTAACTTCTG TTTCCAACAA TGTGGTTGTG GATGGCTCAA TTTCTTACAT CGATGATAAT
CCTCCTGAAG GCAACAGCGA TGCCGCGAGT GGCAATCCAG AGGGCGGCAC AACGATGTCT
AGTTATAGCG TCAAAATTGC GTTGGCCAAT TTAGACAAAG TCAAAAATGG CTACCATATG
CAAGCAACCA TTGATTTAGG CGATTTAGGG GCGATTAAGT TACCGAAAAA AGCGATTCAA
AAAGAGGGTG AACAGGCCTA CGTTTTAGTG AATGATTTTG GAACCATCAT TCGTCGTGAT
GTCCAAGTCG GCAAGAAAA TGGCGACAAA ATGGCGATTG AATCTGGCTT AGAATCAGCC
GACCGAGTGG TTATTTCTTC AAAAAAACCA GTAAAGTCG GTGATATTGT TGAATCAGAT
GCAGCGATTG CTTCTGATGA ATCAGCAACC AACGAATCAA TGACAGATGC GTCGAAAT

EF101-4 (SEQ ID NO:392)
KNAQQVA VKQAPKDDWG IDYFDVPDLQ
QIYINGVIQP EQMEAFARDQ KITKDPEIKV KNGDVVDAGT ELFTYEDEAV TKEIEAQQNS
LAKLETKRAN IYNKWNRAID KFNKTKEEDR TMSGDDLNEQ YQTEVDAVDE EITFTNETLA
DLGAKQYIST KANFKGRVSI PEVKDANSPI LRLTSEDLYL AGKVNEKDLT KISVGQKAKL
TSVSNNVVVD GSISYIDDNP PEGNSDAASG NPEGGTTMSS YSVKIALANL DKVKNGYHMQ
ATIDLGDLGA IELPKKAIQK EGEQAYVLVN DFGTIIRRDV QVGQENGDKM AIESGLESAD
RVVISSKKPV KVGDIVESDA AIASDESATN ESMTDASK

EF102-1 (SEQ ID NO:393)
TAAACATTTG AGACATTCAG AGGTGAATGT CTCTTTTTTA TTACTCAAAA ACGAAAGGGG
ATTAATTATA TGAAAAAAAC AACATTTAAA AATTGGTCGT TATTTGCGAC TTTGGCTCTA
TTAAGTCAAA CAATTGGCGG AACGATTGGT CCTACGATTG CTTTTGCCGA TGAAATTACT
CACCCTCAAG AGGTAACAAT TCATTATGAC GTAAGTAAAC TGTATGAAGT TGACGGAACT
TTTAGCGATG GCAGCACGCT CTCAGAACGT ACTACGTCAT TATATGCAGA ATACAATGGT
GCAAAACAAA CAGTATTTTG TATTGAACCA GGTGTTAGTA TTCCAACAGA AGTGACGCAC
GGTTATCAGA AAACCCTTT GCCATCAATG TCTGATAAAG CGAAACTAGT ATCGGTTCTT
TGGGAAAAGG CTGAACAGA TATTGATACA AATATGGTTG ACAAAAAGAT GATTTGGGAA
GAAGTGAACG GTTATAAACT CCATTCCATA AAAGATTAG GTGGTGCTTC AGTTGATATA
AATCTATTG AAGGAAAAAT TAATAAGGCA ATTGAGGAGT ATCAAAAAAA ACCAAGTTTT
CATAATACCA CTGTAAAAAC AATTTTAGGT CAATCGACAA CTTTAATAGA TAAAAATGAA

TABLE 1-continued

Nucleotide and Amino Acid Seqeuences of *E. faecalis* Genes.

```
TTAAATTTAT CTGAGTTTGA TAAAGTCGTC CAAAATACGG CGAATATAGA TTACCGTGTA
ATTGGGAATC AATTAGTGCT TACTCCAAAC TCTAATTCCA AATCAGGAAC ATTAACATTG
AAAAAATCAG CTGGTACTGG AACTCCAGTC GCTTATAAAA AAGCAGGACT TCAAACTGTG
ATGGCTGGTG CGCTTGATAA GCCCAATACC TACGCTATTA AAATTAATGT GGAAACTAAG
GGTTCTTTAA AGATCAAAAA AATCGATAAA GAATCAGGTG ATATTGTACC AGAAACGTTT
TTCCATTTAG ATTTTGGGAA AGCTTTACCT TCAAAAGATG TGACAACAGA TAAAGATGGG
ATTTCTATTT TGGATGGAAT TCCCCATGGT ACAAAGGTAA CTATTACTGA AAAATCGGTG
CCAGATCCTT ATATGATTGA TACCACACCC ATGGCTGCCA CCATTAAAGC GGGCGAGACC
ATTTCCATGA CTTCGAAAAA TATGCGACAA AAGGTCAAA TTCTTTTAGA GAAGACTGGG
GTAGAAACAG GTACTGATCT TTGGAATGAC AATTATTCTC TAGCTGGAAA TACATTTGCC
ATTCGTAAAG ACAGCCCAGC TGGTGAAATT GTCCAAGAAA TAACAACGGA TGAAAAAGGT
CGTGCGGAAA CACCAAAAGA GCTTGCTAAT GCTTTGGAAC TGGGAACCTA TTACGTGACA
GAAACTAAAT CTAGTAATGG TTTCGTGAAT ACCTTCAAAC CAACAAAAGT CGAGTTAAAA
TATGCCAATC AAACCGTGGC TCTTGTTACC AGTAACGTAA AAGGGCAAAA CCAAGAAATT
ACTGGGGAAA CCACTTTGAC AAAAGAAGAC AAAGATACCG GTAATGAGAG TCAAGGGAAA
GCTGAGTTTA AAGGAGCTGA ATATACTCTC TTTACTGCAA AAGATGGTCA AGCTGTTAAA
TGGAGTGAAG CTTTTAAAAC AGAATTAGTG AAGGGAACGA AAGCTTCTGA TGAAACAGTG
ACTTTGGCTT TAGATGAAAA GAACCAAGTT GCCGTTAAAC ACCTAGCAAT TAACGAGTAT
TTCTGGCAAG AAACCAAAGC ACCTGAAGGA TATACTTTGG ATGAAACGAA GTATCCTGTA
TCCATCAAAA AGTTGATAA TAACTAAAAA AATGCCGTAA TTACTCGAGA TGTTACGGCA
AAAGAACAAG TTATTCGCTT TGGCTTTGAT TTCTTTAAAT TTGCTGGATC GGCTGATGGC
ACTGCCGAAA CTGGATTTAA CGACTTATCT TTTAAAGTGT CGCCATTGGA AGGGACCAAN
GAAATCACAG GTGCTGAAGA TAAAGCGACC ACAGCTTGTA ACGAGCAATT AGGTTTTGAT
GGCTATGGTA AGTTTGAAAA TCTTCCTTAT GGGGATTATT TACTTGAAGA AATAGAGGCT
CCAGAAGGAT TTCAAAAGAT TACACCACTA GAAATCCGTT CTACATTTAA GGAAAACAAA
GACGACTATG CGAAGAGTGA GTATGTCTTT ACCATTACCG AAGAAGGACA AAAACAACCA
ATTAAGATGG TGACCGTTCC TTACGAGAAA CTAACTAACA ACGAGTTTTC TGTTAGTCTG
AACCGTTTGA TGCTTTATGA TTTGCCCGAG AAAGAAGATA GTTTGACTTC TCTTGCGACT
TGGAAAGACG GAAATAAAAA ATTGAATACC CTTGATTTTA CCGAGCTAGT TGATAAATTG
AGATATAACT TGCATGAAAT CAAAGAAGAC TGGTATGTCG TAGCTCAAGC CATTGATGTG
GAAGCCACAA AAGCTGCCCA AGAAAAAGAC GAAAAAGCCA AACCGGTGGT GATTGCCGAA
ACAACCGCAA CGTTGGCGAA CAAAGAGAAA ACTGGAACTT GGAAAATTCT GCATAAATTA
ACCGCTGAAC AAGTTTTGGA TAAAAGCATC GTCTTGTTCA ATTATGTGTA TGAAAACAAG
GTAGCCTTTG AAGCAGGCAA TGAGCCAGTA GCGAAGGATG CTAGCTTGAA CAATCAAGCA
CAAACCGTCA ATTGTACGAT TGAACGCCAT GTTTCCATCC AAACAAAAGC CCACCTAGAA
GATGGTTCGC AAACTTTTAC TCATGGTGAC GTGATGGATA TGTTTGATGA TGTGTCGGTT
ACCCATGATG TACTGGATGG CTCAAAAGAA GCTTTCGAAA CAATTCTGTA TGCTTTACTA
CCAGATGGTA CGAACAAAGA AATTTGGAAA TCTGGCAAAA TTGAGCATGA AGTGAATGAT
AAAGAATTTA CCAAAACCGT ACTTGCGGAA AAAGTAGATA CCGGAAAGTA TCCAGAAGGA
ACTAAGTTTA CTTTTACGGA AATCAATTAC GAAAAGATG GAAACGTGAA TGGAAAACAC
AATGAAGATT TGAAAGAAAA ATCTCAAACC TTAACACCAA AAGAAGTGCC AACCATACCG
AGTACGCCAA AACAACCGGA AACACCAGCT GTTCCAAGTA ATTCTCAAGA ATCTAGTCCC
ACAGTGAAGA CATTCCCGCA AACTGGGGAG AAAAATTCCA ACGTTCTACT GTTAGTTGGC
TTTATCTTGA TTTTTTCGAC TGCTGGGTAT TATTTCTGGA ATCGCCGCAA TTAA

EF102-2 (SEQ ID NO:394)
MKKTTFKN WSLFATLALL SQTIGGTIGP TIAFADEITH
PQEVTIHYDV SKLYEVDGTF SDGSTLSERT TSLYAEYNGA KQTVFCIEPG VSIPTEVTHG
YQKNPLPSMS DKAKLVSVLW EKAGTDIDTN MVAQKMIWEE VNGYKLHSIK RLGGASVDIK
SIEGKINKAI EEYQKKPSFH NTTVKTILGQ STTLIDKNEL NLSEFDKVVQ NTANIDYRVI
GNQLVLTPNS NSKSGTLTLK KSAGTGTPVA YKKAGLQTVM AGALDKPNTY AIKINVETLG
SLKIKKIDKE SGDIVPETVF HLDFGKALPS KDVTTDKDGI SILDGIPHGT KVTITEKSVP
DPYMIDTTPM AATIKAGETI SMTSKNMRQK GQILLEKTGV ETGTDLWNDN YSLAGNTFAI
RKDSPAGEIV QEITTDEKGR AETPKELANA LELGTYYVTE TKSSNGFVNT FKPTKVELKY
ANQTVALVTS NVKGQNQEIT GETTLTKEDK DTGNESQGKA EFKGAEYTLF TAKDGQAVKW
SEAFKTELVK GTKASDETVT LALDEKNQVA VKHLAINEYF WQETKAPEGY TLDETKYPVS
IKKVDNNEKN AVITRDVTAK EQVIRFGFDF FKFAGSADGT AETGFNDLSF KVSPLEGTXE
ITGAEDKATT ACNEQLGFDG YGKFENLPYG DYLLEEIEAP EGFQKITPLE IRSTFKENKD
DYAKSEYVFT ITEEGQKQPI KMVTVPYEKL TNNEFSVSLN RLMLYDLPEK EDSLTSLATW
KDGNKKLNTL DFTELVDKLR YNLHEIKEDW YVVAQAIDVE ATKAAQEKDE KAKPVVIAET
TATLANKEKT GTWKILHKLT AEQVDKSIV LFNYVYENKV AFEAGNEPVA KDASLNNQAQ
TVNCTIERHV SIQTKAHLED GSQTFTHGDV MDMFDDVSVT HDVLDGSKEA FETILYALLP
DGTNKEIWKS GKIEHEVNDK EFTKTVLAEK VDTGKYPEGT KFTFTEINYE KDGNVNGKHN
EDLKEKSQTL TPKEVPTIPS TPKQPETPAV PSNSQESSPT VKTFPQTGEK NSNVLLLVGF
ILIFSTAGYY FWNRRN

EF102-3 (SEQ ID NO:395)
TT TAGATGAAAA GAACCAAGTT GCCGTTAAAC ACCTAGCAAT TAACGAGTAT
TTCTGGCAAG AAACCAAAGC ACCTGAAGGA TATACTTTGG ATGAAACGAA GTATCCTGTA
TCCATCAAAA AGTTGATAA TAACGAAAAA AATGCCGTAA TTACTCGAGA TGTTACGGCA
AAAGAACAAG TTATTCGCTT TGGCTTTGAT TTCTTTAAAT TTGCTGGATC GGCTGATGGC
ACTGCCGAAA CTGGATTTAA CGACTTATCT TTTAAAGTGT CGCCATTGGA AGGGACCAAN
GAAATCACAG GTGCTGAAGA TAAAGCGACC ACAGCTTGTA ACGAGCAATT AGGTTTTGAT
GGCTATGGTA AGTTTGAAAA TCTTCCTTAT GGGGATTATT TACTTGAAGA AATAGAGGCT
CCAGAAGGAT TTCAAAAGAT TACACCACTA GAAATCCGAA CTACATTTAA GGAAAACAAA
GACGACTATG CGAAGAGTGA GTATGTCTTT ACCATTACCG AAGAAGGACA AAAACAACCA
ATTAAGATGG TGACCGTTCC TTACGAGAAA CTAACTAACA ACGAGTTTTC TGTTAGTCTG
```

TABLE 1-continued

Nucleotide and Amino Acid Seqeuences of E. faecalis Genes.

```
AACCGTTTGA TGCTTTATGA TTTGCCCGAG AAAGAAGATA GTTTGACTTC TCTTGCGACT
TGGAAAGACG GAAATAAAAA ATTGAATACC CTTGATTTTA CCGAGCTAGT TGATAAATTG
AGATATAACT TGCATGAAAT CAAAGAAGAC TGGTATGTCG TAGCTCAAGC CATTGATGTG
GAAGCCACAA AAGCTGCCCA AGAAAAAGAC GAAAAAGCCA AACCGGTGGT GATTGCCGAA
ACAACCGCAA CGTTGGCGAA CAAAGAGAAA ACTGGAACTT GGAAAATTCT GCATAAATTA
ACCGCTGAAC AAGTTTTGGA TAAAAGCATG GTCTTGTTCA ATTATGTGTA TGAAAACAAG
GTAGCCTTTG AAGCAGGCAA TGAGCCAGTA GCGAAGGATG CTAGCTTGAA CAATCAAGCA
CAAACCGTCA ATTGTACGAT TGAACGCCAT GTTTCCATCC AAACAAAAGC CCACCTAGAA
GATGGTTCGC AAACTTTTAC TCATGGTGAC GTGATGGATA TGTTTGATGA TGTGTCGGTT
ACCCATGATG TACTCGATGG CTCAAAAGAA GCTTTCGAAA CAATTCTGTA TGCTTTACTA
CCAGATGGTA CGAACAAAGA AATTTGGAAA TCTGGCAAAA TTGAGCATGA AGTGAATGAT
AAAGAATTTA CCAAAACCGT ACTTGCGGAA AAAGTAGATG CCGGAAAGTA TCCAGAAGGA
ACTAAGTTTA CTTTTACGGA AATCAATTAC GAAAAAGATG GAAACGTGAA TGGAAAACAC
AATGAAGATT TGAAAGAAAA ATCTCAAACC TTAACACCAA AAGAAGTGCC AACCATACCG
AGTACGCCAA AACAACCGGA AACACCAGCT GTTCCAAGTA ATTCTCAAGA ATCTAGTCCC
ACAGTGAAGA

EF102-4 (SEQ ID NO:396)
LDEKNQVA VKHLAINEYF WQETKAPEGY TLDETKYPVS
IKKVDNNEKN AVITRDVTAK EQVIRFGFDF FKFAGSADGT AETGFNDLSF KVSPLEGTXE
ITGAEDKATT ACNEQLGFDG YGKFENLPYG DYLLEEIEAP EGFQKITPLE IRSTFKENKD
DYAKSEYVFT ITEEGQKQPI KMVTVPYEKL TNNEFSVSLN RLMLYDLPEK EDSLTSLATW
KDGNKKLNTL DFTELVDKLR YNLHEIKEDW YVVAQAIDVE ATKAAQEKDE KAKPVVIAET
TATLANKEKT GTWKILHKLT AEQVLDKSIV LFNYVYENKV AFEAGNEPVA KDASLNNQAQ
TVNCTIERHV SIQTKAHLED GSQTFTHGDV MDMFDDVSVT HDVLDGSKEA FETILYALLP
DGTNKEIWKS GKIEHEVNDK EFTKTVLAEK VDTGKYPEGT KFTFTEINYE KDGNVNGKHN
EDLKEKSQTL TPKEVPTIPS TPKQPETPAV PSNSQESSPT VK

EF103-1 (SEQ ID NO:397)
TAAGATAGGT TTATCAAAGA AAAGGAGCGA TGCTTTATGA AAAAGAAAGT ATTAAGTTCG
ATTACTTTAG TAACATTAAG TACGTTACTT ATAGCAGGTT ATGCAAGTCC AGCATTTGCA
GATCATGCAG CCAATCCAAA TAGTGCTACA GCAAATTTAG GCAAACATCA AAACAATGGC
CAAACAAGAG GCGACAAGGC GACTAAGATT TTATCTGGCA CGGACTGGCA AGGAACCCGT
GTTTATGATG CTGCTGGTAA TGATTTAACG GCAGAAAATG CTAATTTTAT TGGTTTAGCA
AAATATGATG GTGAAACCGG TTTTTACGAG TTTTTCGACA AAAATACTGG GGAAACCCGT
GGTGACGAAG GAACATTTTT TGTGACAGGT GATGGCACAA AACGAATTTT AATTTCGCGG
ACACAAAATT ATCAAGCCGT AGTGGATTTG ACCGAAGTGA GTAAAGACNA ATTTACTTAC
AAGCGTTTAG GGAAAGATAA ACTGGGGAAT GATGTTGAAG GTTTACGTGA ACACATCCGT
TATCATGGGA AAAAATTAGC TTTTACAAAT GGACGTGAAG CATTAACCAA TCAAACTGGC
AAAATTGTGA CAAATAAATC AGGGGATAAA ATTTTAGGAA CAACCTTGTG GAATGGCACA
AAAGTCGTAG ATAAAAACGG TAATGATGTG ACAGCGGCCA ATCAAAATTT CATTAGTTTA
GCGAAATTTG ATCCAAACAC AAGTAAATAT GAATTTTTCA ATTTACAAAC AGGTGAAACC
CGCGGCGACT TTGGGTACTT CCAAGTGGTG GACAATAACA AGATTCGGGC CCATGTATCT
ATTGGTACGA ATCGTTACGG CGCGGCGCTA GAATTAACGG AACTAAACAA TGATCGATTT
ACGTATACTC GAATGGGTAA AGATAATGCT GGTAATGATA TTCAAGTGTT CGTGGAACAT
GAACCTTACC AAGGCACATA TCATCCAGCC TTTACTTTCA AA

EF103-2 (SEQ ID NO:398)
MKKKVLSSI TLVTLSTLLI AGYASPAFAD HAANPNSATA NLGKHQNNGQ
TRGDKATKIL SGTDWQGTRV YDAAGNDLTA ENANFIGLAK YDGETGFYEF FDKNTGETRG
DEGTFFVTGD GTKRILISRT QNYQAVVDLT EVSKDXFTYK RLGKDKLGND VEVYVEHIPY
HGKKLAFTNG REALTNQTGK IVTNKSGDKI LGTTLWNGTK VVDKNGNDVT AANQNFISLA
KFDPNTSKYE FFNLQTGETR GDFGYFQVVD NNKIRAHVSI GTNRYGAALE LTELNNDRFT
YTRMGKDNAG NDIQVFVEHE PYQGTYHPAF TF

EF103-3 (SEQ ID NO:399)
TCATGCAG CCAATCCAAA TAGTGCTACA GCAAATTTAG GCAAACATCA AAACAATGGC
CAAACAAGAG GCGACAAGGC GACTAAGATT TTATCTGGCA CGGACTGGCA AGGAACCCGT
GTTTATGATG CTGCTGGTAA TGATTTAACG GCAGAAAATG CTAATTTTAT TGGTTTAGCA
AAATATGATG GTGAAACCGG TTTTTACGAG TTTTTCGACA AAAATACTGG GGAAACCCGT
GGTGACGAAG GAACATTTTT TGTGACAGGT GATGGCACAA AACGAATTTT AATTTCGCGG
ACACAAAATT ATCAAGCCGT AGTGGATTTA ACCGAAGTGA GTAAAGACNA ATTTACTTAC
AAGCGTTTAG GGAAAGATAA ACTGGGGAAT GATGTTGAAG GTTTACGTGA ACACATCCGT
TATCATGGGA AAAAATTAGC TTTTACAAAT GGACGTGAAG CATTAACCAA TCAAACTGGC
AAAATTGTGA CAAATAAATC AGGGGATAAA ATTTTAGGAA CAACCTTGTG GAATGGCACA
AAAGTCGTAG ATAAAAACGG TAATGATGTG ACAGCGGCCA ATCAAAATTT CATTAGTTTA
GCGAAATTTG ATCCAAACAC AAGTAAATAT GAATTTTTCA ATTTACAAAC AGGTGAAACC
CGCGGCGACT TTGGGTACTT CCAAGTGGTG GACAATAACA AGATTCGGGC CCATGTATCT
ATTGGTACGA ATCGTTACGG CGCGGCGCTA GAATTAACGG AACTAAACAA TGATCGATTT
ACGTATACTC GAATGGGTAA AGATAATGCT GGTAATGATA TTCAAGTGTT CGTGGAACAT
GAACCTTACC AAGGCACATA TCATCCAGCC T

EF103-4 (SEQ ID NO:400)
HAANPNSATA NLGKHQNNGQ
TRGDKATKIL SGTDWQGTRV YDAAGNDLTA ENANFIGLAK YDGETGFYEF FDKNTGETRG
DEGTFFVTGD GTKRILISRT QNYQAVVDLT EVSKDXFTYK RLGKDKLGND VEVYVEHIPY
HGKKLAFTNG REALTNQTGK IVTNKSGDKI LGTTLWNGTK VVDKNGNDVT AANQNFISLA
```

TABLE 1-continued

Nucleotide and Amino Acid Seqeuences of *E. faecalis* Genes.

KFDPNTSKYE FFNLQTGETR GDFGYFQVVD NNKIRAHVSI GTNRYGAALE LTELNNDRFT
YTRMGKDNAG NDIQVFVEHE PYQGTYHPA

EF104-1 (SEQ ID NO:401)
TGAAAGGGGA TTAGTATGAA GAAAAAAACT TTTTCTTTTG TGATGTTGAG TATACTTCTC
GCACAAAATT TCGGGTTTGC CGTAAATGCC TATGCTGTAA CAACGACAGA AGCACAAACA
GAGACCACTG ATACAGCAAA AAAAGAGGCA GAGTTATCGA ACTCAACACC ATCTTTACCT
TTAGCAACAA CGACTACTTC AGAAATGAAT CAACCAACTG CAACAACTGA ATCGCAAACC
ACAGAGGCGA GCACAACAGC TTCCAGTGAT GCTGCTACAC CATCTGAACA ACAAACAACG
GAGGACAAGG ACACCTCACT TAATGAAAAA GCCCTGCCAG ATGTTCAAGC GCCAATTACA
GATGAACTAC TTGACAGTAT GAGTCTTGCG CCGATTGGTG AACAGAATA CAGCCAAACA
GAGGTTCACC GCGAATTAAA TACAACACCG GTAACCGCTA CGTTCCAATT TGCTGTTGGA
AACACAGGTT ATGCACCTGG ATCAGTTTAT ACAGTTCAAT TACCAGAACA TTTAGGTTAT
TCAACTGTCA GCGGAGAAGT GACAGGCATT GGCGCAACTT GGGCAGTCGA TGCGGCGACC
AAAACATTAA GTATTACGTT TAATCAACGA GTTTCAGATA CTTCCTTTAA AGTAGAACTA
AAAAGTTATC TAACAACAGA GGCGGAACCA TTAATCAAAA TTGAAACTCC AGGAAAAAAT
AAAAAAACCT ACTCGTTTGA TTTATATGAA CAAGTGGAC CAATTCAATA TAACGAACGA
ACCAGAACGA CGGGGTTAGA TGGCGAAATT TTTTATAATT TAGACCGGAC GTTAACTGGC
AATCAAACAT TAGAATTATT AACAACAGAG ACGCCAGGCG CTGTCTTTGG AAAACAAGAT
AACTTGGAAC CTCAAGTTTT CAGTTACGAT GTCGACATTA ATGGTCAAAT TTACCAGAA
ACGCAAACCT TGTTAACACC TGGCAAAGAT TATACATTAA GCGATAATTC ACTCGGGCGG
ATTGCTGTAA CTGTTCCAAA CATGAATCAA CAAAAAGCCT ATTCCTTATC GATTAATCGG
ACAATTTATT TAGAGAGTGC TTCCGACTAT AACTACTTAT ATTCGCAGCA GTATCCAACA
ACAAAAATTG GGTCAATTTC TTTGAAAAGT ACGACAGGAA CTAAACAAAC AACCGATTTT
ACTGCTAAGA CGAGTCAAAC AAGTAAAGTA ATTGCTGATC GTGAAATGCG TAGTATGTCC
TATATCAGTT TCAAAGCAA AGGGAAATAT TATGTAACAA TTTATGGCAC GTTAACAGAA
ACAAAAGTGG GTCAACAAAT CGTATTAGAG AGTACAAACG GTCAAGAAAT TAAGAATCCT
AAATTTACGG CGTATGGTCC TTTATATGAA AATGTAAAAT TGGAAGACTA TTTTGATATT
AAAACTGAAG GTGGCAAGCT CACTTTAACG GCCACAAAAG ATAGCTATTT AAGAATAAAT
ATTTCTGATT TAACAATGGA TTTTGACAAG AAGGACATTA ATCTATCATT AAGTACACCT
GTAATTGGTC CTAATAAAGC CATTCAATTA GTATCCGATC AATATATTGA ACCAATTAGT
GTTGTTAATC CTTTCAATGC TGAAACTGCT TGGGGTAATT ATGATCAAAA TGGTGCCTAT
TCATCAAGAA CAACTGTCTC AGTTATGGGA AGCAAAGAGA AACCGATTCA AAATTTAGAA
ATTAAAGTAA AGCATCCTAA TTATCTTTCA TTACGAGCTA CAAAAGAAAT TTATTTTTAT
TACAAGTTAG GAACGGATTA TACAGTAACG CCAACGTCAG ATGGTTCAGT TATTAAGTTC
ACTACGCCAA TAACCAACGA AATCCAAATT CCAATTGGTT TTAATTATGT GCCAGATAGT
TTGCCAAAAG ATAAAAGTAT CCCAGTCGAT ACGATACCGA TAACAATGAG TGCTGAAGGT
TTAACTCCAG TTGATACGAC AGTAACTACT AATAGTAAGC GTGGTTCTGA ACGAACACTT
CAAAGTAGTA AAAATCAATT CCTTGTCAAT GCACGAAATG ATTCTTTTGA CTCACTAAGC
GTCCGTACAA AAATTCCAGC TGGCGCCGAT GTTCTTTTTG ACATTTATGA TGTTTCAAAC
GATCAGGTAG ATTCAATTTA TCCACAATAC TGGGACCGCG GTCAATACTT TGATAAACCA
ATGACGCCAA ACAGCCCTGG ATATCCAACG ATTACTTTTG ACGAAAATAC CAATAGTTAC
ACGTTTGATT TTGGAAAAAC CAACAAACGT TACATTATTG AGTATAAAAA CGCCAATGGC
TGGATCGACG TGCCAAGTGT TTATATAACA GGGACAGCGA AAGAACCACA ATCGAATAAT
AATGAAGGCT CTGCTTCGGT TTCTGTTCAA AATGAAGCGT TAGACATTTT GAGTGCAACA
CAAGCGGCGA ATCCAACATT AAAAAATGTA ACAAAAACGA CAGTAACAAC AAAAAATATT
GATAATAAAA CACATCGTGT GAAAAATCCA ACGATTGAAT TAACACCAAA AGGCACAACC
AATGCTCAAA TCGATTTGAA TTCTATTACC GTGAAAGGCG TGCCAGAAGA TGCTTATTCA
TTAGAGAAGA CTACAAACGG TGCGAAAGTC ATTTTTAAAG ACTATACATT GACAGAAAAC
ATTACGATTG AATACAATAC GGTCTCTGCA AACGCTGGCC AAATCTATAC AGAAACAACA
ATCGACTCTG AAACATTGAA CCAGATGTCT GCTAGCAAGA AAAAGTCAC CACTGCGCCA
ATCACATTGA AATTCTCAGA AGGTGATGCG GAAGGTATTG TTTATTTAGC AACTGCCACA
TTCTACACGC ATAACGTAGA GGATGAAAAC CAAGCAATTG CGAAGGTTTC TTTTGAACTA
ATTGATAATG TCACGCATAC AGCAACCGAA TTTACAACAG ATGAAAAAGG TCAATACTCC
TTTGATGCCA TCATGACAGG TGATTATACT TTGCGAGTAA CGAATGTACC GCAGGAATAT
TCCGTGGATG AAGAGTATTT GACAGGAAAA GCCATTAAGC TGGTCAAAGG AGACAACCAA
CTAAAAATTC CATTAACGAA AACAATTGAT CACAGTCGTT TACAAGTCAA AGATTCAACG
ATTTATGTCG GCGATTCATG GAAACCAGAA GAGAACTTTG TTTCAGCAAC AGATAAAACA
GGTCAAGACG TTCCCTTCGA AAAAATCACT GTTTCAGGTC AAGTTGATAA CANCAAAGCA
GGCGTTTATC CAATTATTTA CAGTGACGAA GGTAAAGAAG AAACAGCCTA TGTGACCGTC
AAACCCGACC AATCTAAGTT AGAGGTCAAA GATACAACGA TTTATGTTGG TGATTCGTGG
AAACCAGAAG ATAATTTCGT TTCAGCGACA GACAAAACAG GTCAAGACGT NCCGTTTGAA
AAAATTGATG TTCAGGGAAC AGTGAATGTT GATAAAATAG GCGATTATGA AATTGTCTAT
AAAAATGGCA NAAAAGAAGC GAAAGCAATC GTTCATGTCC GTGATGACAG TCAGTTAGAG
GTTAAAGATA CAACGATTTA TGTTGGTGAT TCGTGGAAAC CAGAAGATAA TTTCGTTTCA
GCAACAGACA AAACAGGCCA AGACGTTCCG TTTGAAAAAA TCACTGTTTC AGGTCAAGTT
GATACTAGCA AAGCAGGCGT TTATCCAATC GTTTACAGTT ACGAAGGTAA AGAAGAAACA
GCTAATGTGA CTGTCAAACC CGACCAATCT AAGTTAGAGG TTAAAGATAC AACGATTTAT
GTGGGCGATA AATGGGAACC AGAAGATAAT TTCGTTTCAG CAACAGACAA AACAGGTCAA
GATGTCCCGT TTGAAAAAAT TGACGTTCAG GGAACAGTGA ATGTTGATAA AATAGGCGAT
TATGAAATTG TCTATAAAAA TGGCACAAAA GAAGCGAAAG CAATCGTTCA TGTCCGTGAT
GACAGTCAGT TAGAGGTCAA AGATACAACA ATTTATGTGG GTGATAAATG GGAAGCAGAA
GATAACTTCG TTTCCGCGAC AGACAAAACA GGTCAAGACG TTCCGTTTGA AAAAATTGAT
GTTCAGGGAA CAGTGAATGT TGATAAAATA GGCGATTATG AAATTGTCTA TAAAAATGGC
ACAAAAGAAG CGAAAGCAAT CGTTCATGTC CGTGATGATA GTCGTTTACA AGTCAAGGAT
ACAACGATTT ATGTCGGCGA TTCNTGGACA CCAGAAGNGA ACTTTGTTTC AGCNACAGAT
AAAACAGGTC AAGATGTCCC ATTCGAAAAA ATCACTGTT

TABLE 1-continued

Nucleotide and Amino Acid Seqeuences of E. faecalis Genes.

EF104-2 (SEQ ID NO:402)
MKKKTF SFVMLSILLA QNFGFAVNAY AVTTTEAQTE TTDTAKKEAE LSNSTPSLPL
ATTTTSEMNQ PTATTESQTT EASTTASSDA ATPSEQQTTE DKDTSLNEKA LPDVQAPITD
ELLDSMSLAP IGGTEYSQTE VHRELNTTPV TATFQFAVGN TGYAPGSVYT VQLPEHLGYS
TVSGEVTGIG ATWAVDAATK TLSITFNQRV SDTSFKVELK SYLTTEAEPL IKIETPGKNK
KTYSFDLYEQ VEPIQYNERT RTTGLDGEIF YNLDRTLTGN QTLELLTTET PGAVFGKQDN
LEPQVFSYDV DINGQILPET QTLLTPGKDY TLSDNSLGRI AVTVPNMNQQ KAYSLSINRT
IYLESASDYN YLYSQQYPTT KIGSISLKST TGTKQTTDFT AKTSQTSKVI ADREMRSMSY
ISFQSKGKYY VTIYGTLTET KVGQQIVLES TNGQEIKNPK FTAYGPLYEN VKLEDYFDIK
TEGGKLTLTA TKDSYLRINI SDLTMDFDKK DINLSLSTPV IGPNKAIQLV SDQYIEPISV
VNPLNAETAW GNYDQNGAYS SRTTVSVMGS KEKPIQNLEI KVKHPNYLSL RATKEIYFYY
KLGTDYTVTP TSDGSVIKFT TPITNEIQIP IGFNYVPDSL PKDKSIPVDT IPITMSAEGL
TPVDTTVTTN SKRGSERTLQ SSKNQFLVNA RNDSFDSLSV RTKIPAGADV LFDIYDVSND
QVDSIYPQYW DRGQYFDKPM TPNSPGYPTI TFDENTNSYT FDFGKTNKRY IIEYKNANGW
IDVPTLYITG TAKEPQSNNN EGSASVSVQN EALDILSATQ AANPTLKNVT KTTVTTKNID
NKTHRVKNPT IELTPKGTTN AQIDLNSITV KGVPEDAYSL EKTTNGAKVI FKDYTLTENI
TIEYNTVSAN AGQIYTETTI DSETLNQMSA SKKKVTTAPI TLKFSEGDAE GIVYLATATF
YTHNVEDENQ AIAKVSFELI DNVTHTATEF TTDEKGQYSF DAIMTGDYTL RVTNVPQEYS
VDEEYLTGKA IKLVKGDNQL KIPLTKTIDH SRLQVKDSTI YVGDSWKPEE NFVSATDKTG
QDVPFEKITV SGQVDNXKAG VYPIIYSDEG KEETAYVTVK PDQSKLEVKD TTIYVGDSWK
PEDNFVSATD KTGQDVPFEK IDVQGTVNVD KIGDYEIVYK NGXKEAKAIV HVRDDSQLEV
KDTTIYVGDS WKPEDNFVSA TDKTGQDVPF EKITVSGQVD TSKAGVYPIV YSEYGKEETA
NVTVKPDQSK LEVKDTTIYV GDKWEPEDNF VSATDKTGQD VPFEKIDVQG TVNVDKIGDY
EIVYKNGTKE AKAIVHVRDD SQLEVKDTTI YVGDKWEAED NFVSATDKTG QDVPFEKIDV
QGTVNVDKIG DYEIVYKNGT KEAKAIVHVR DDSRLQVKDT TIYVGDSWXP EXNFVSATDK
TGQDVPFEKI TV

EF104-3 (SEQ ID NO:403)
TGTAA CAACGACAGA AGCACAAACA
GAGACCACTG ATACAGCAAA AAAAGAGGCA GAGTTATCGA ACTCAACACC ATCTTTACCT
TTAGCAACAA CGACTACTTC AGAAATGAAT CAACCAACTG CAACAACTGA ATCGCAAACC
ACAGAGGCGA GCACAACAGC TTCCAGTGAT GCTGCTACAC CATCTGAACA ACAAACAACG
GAGGACAAGG ACACCTCACT TAATGAAAAA GCCCTGCCAG ATGTTCAAGC GCCAATTACA
GATGAACTAC TTGACAGTAT GAGTCTTGCG CCGATTGGTG GAACAGAATA CAGAACCCAC
GAGGTTCACC GCGAATTAAA TACAACACCG GTAACCGCTA CGTTCCAATT TGCTGTTGGA
AACACAGGTT ATGCACCTGG ATCAGTTTAT ACAGTTCAAT TACCAGAACA TTTAGGTTAT
TCAACTGTCA GCGGAGAAGT GACAGGCATT GGCGCAACTT GGGCAGTCGA TGCGGCGACC
AAAACATTAA GTATTACGTT TAATCAACGA GTTTCAGATA CTTCCTTTAA AGTAGAACTA
AAAAGTTATC TAACAACAGA GGCGGAACCA TTAATCAAAA TTGAAACTCC AGGAAAAAAT
AAAAAAACCT ACTCGTTTGA TTTATATGAA CAAGTGGAAC CAATTCAATA TAACGAACGA
ACCAGAACGA CGGGGTTAGA TGGCGAAATT TTTTATAATT TAGACCGGAC GTTAACTGGC
AATCAAACAT TAGAATTATT AACAACAGAG ACGCCAGGCG CTGTCTTTGG AAAACAAGAT
AACTTGGAAC CTCAAGTTTT CAGTTACGAT GTCGACATTA ATGGTCAAAT TTTACCAGAA
ACGCAAACCT TGTTAACACC TGGCAAAGAT TATACATTAA GCGATAATTC ACTCGGGCGG
ATTGCTGTAA CTGTTCCAAA CATGAATCAA CAAAAAGCCT ATTCCTTATC GATTAATCGG
ACAATTTATT TAGAGAGTGC TTCGGACTAT AACTACTTAT ATTCGCAGCA GTATCCAACA
ACAAAAATTG GGTCAATTTC TTTGAAAAGT ACGACAGGAA CTAAACAAAC AACCGATTTT
ACTGCTAAGA AGAGTCAAAC AAGTAAAGTA ATTGCTGATC GTGAAATGCG TAGTATGTCC
TATATCAGTT TTCAAAGCAA AGGGAAATAT TATGTAACAA TTTATGGCAC GTTAACAGAA
ACAAAAGTGG GTCAACAAAT CGTATTAGAG AGTACAAACG GTCAAGAAAT TAAGAATCCT
AAATTTACGG CGTATGGTCC TTTATATGAA AATGTAAAAT TGGAAGACTA TTTTGATATT
AAAACTGAAG GTGGCAAGCT CACTTTAACG GCCACAAAAG ATAGCTATTT AAGAATAAAT
ATTTCTGATT TAACAATGGA TTTTGACAAG AAGGACATTA ATCTATCATT AAGTACACCT
GTAATTGGTC CTAATAAAGC CATTCAATTA GTATCCGATC AATATATTGA ACCAATTAGT
GTTGTTAATC CTTTGAATGC TGAAACTGCT TGGGGTAATT ATGATCAAAA TGGTGCCTAT
TCATCAAGAA CAACTGTCTC AGTTATGGGA AGCAAAGAGA AACCGATTCA AAATTTAGAA
ATTAAAGTAA AGCATCCTAA TTATCTTTCA TTACGAGCTA CAAAAGAAAT TTATTTTTAT
TACAAGTTAG GAACGGATTA TACAGTAACG CCAACGTCAG ATGGTTCAGT TATTAAGTTC
ACTACGCCAA TAACCAACGA AATCCAAATT CCAATTGGTT TTAATTATGT GCCAGATAGT
TTGCCAAAAG ATAAAGTAT CCCAGTCGAT ACGATACCGA TAACAATGAG TGCTGAAGGT
TTAACTCCAG TTCATACGAC AGTAACTACT AATAGTAAGC GTGGTTCTGA ACGAACACTT
CAAAGTAGTA AAAATCAATT CCTTGTCAAT GCACGAAATG ATTCTTTTGA CTCACTAAGC
GTCCGTACAA AAATTCCAGC TGGCGCCGAT GTTCTTTTTG ACATTTATGA TGTTTCAAAC
GATCAGGTAG ATTCAATTTA TCCACAATAC TGGGACCGCG GTCAATACTT TGATAAACCA
ATGACGCCAA ACAGCCCTGG ATATCCAACG ATTACTTTTG ACGAAAATAC CAATAGTTAC
ACGTTTGATT TTGGAAAAAC CAACAAACGT TACATTATTG AGTATAAAAA CGCCAATGGC
TGGATCGACG TGCCAACTCT TTATATAACA GGGACAGCGA AAGAACCACA ATCGAATAAT
AATGAAGGCT CTGCTTCGGT TTCTGTTCAA AATGAAGCGT TAGACATTTT GAGTGCAACA
CAAGCGGCGA ATCCAACATT AAAAAATGTA ACAAAAACGA ACGTAACAAC AAAAAATATT
GATAATAAAA CACATCGTGT GAAAAATCCA ACGATTGAAC TAACACCAAA AGGCACAACC
AATGCTCAAA TCGATTTGAA TTCTATTACC GTGAAAGGCG TGCCAGAAGA TGCTTATTCA
TTAGAGAAGA CTACAAACGG TGCGAAAGTC ATTTTTAAAG ACTATACATT GACAGAAAAC
ATTACGATTG AATACAATAC GGTCTCTGCA AACGCTGGCC AAATCTATAC AGAAACAACA
ATCGACTCTG AAACATTGAA CCAGATGTCT GCTAGCAAGA AAAAGTCAC CACTGCGCCA
ATCACATTGA AATTCTCAGA AGGTGATGCG GAAGGTATTG TTTATTTAGC AACTGCCACA
TTCTACACGC ATAACGTAGA GGATGAAAAC CAAGCAATTG CGAAGGTTTC TTTTGAACTA

TABLE 1-continued

Nucleotide and Amino Acid Seqeuences of *E. faecalis* Genes.

```
ATTGATAATG TCACGCATAC AGCAACCGAA TTTACAACAG ATGAAAAAGG TCAATACTCC
TTTGATGCCA TCATGACAGG TGATTATACT TTGCGAGTAA CGAATGTACC GCAGGAATAT
TCCGTGGATG AAGAGTATTT GACAGGAAAA GCCATTAAGC TGGTCAAAGG AGACAACCAA
CTAAAAATTC CATTAACGAA AACAATTGAT CACAGTCGTT TACAAGTCAA AGATTCAACG
ATTTATGTCG GCGATTCATG GAAACCAGAA GAGAACTTTG TTTCAGCAAC AGATAAAACA
GGTCAAGACG TTCCCTTCGA AAAAATCACT GTTTCAGGTC AAGTTGATAA CANCAAAGCA
GGCGTTTATC CAATTATTTA CAGTGACGAA GGTAAAGAAG AAACAGCCTA TGTGACCGTC
AAACCCGACC AATCTAAGTT AGAGGTCAAA GATACAACGA TTTATGTTGG TGATTCGTGG
AAACCAGAAG ATAATTTCGT TTCAGCGACA GACAAAACAG GTCAAGACGT NCCGTTTGAA
AAAATTGATG TTCAGGGAAC AGTGAATGTT GATAAAATAG GCGATTATGA AATTGTCTAT
AAAAATGCA NAAAAGAAGC GAAAGCAATC GTTCATGTCC GTGATGACAG TCAGTTAGAG
GTTAAAGATA CAACGATTTA TGTTGGTGAT TCGTGGAAAC CAGAAGATAA TTTCGTTTCA
GCAACAGACA AAACAGGCCA AGACGTTCCG TTTGAAAAAA TCACTGTTTC AGGTCAAGTT
GATACTAGCA AAGCAGGCGT TTATCCAATC GTTTACAGTT ACGAAGGTAA AGAAGAAACA
GCTAATGTGA CTGTCAAACC CGACCAATCT AAGTTAGAGG TTAAACATAC AACGATTTAT
GTGGGCGATA ATGGGAACC AGAAGATAAT TTCGTTTCAG CAACAGACAA AACAGGTCAA
GATGTCCCGT TTGAAAAAAT TGACGTTCAG GGAACAGTGA ATGTTGATAA AATAGGCGAT
TATGAAATTG TCTATAAAAA TGGCACAAAA GAAGCGAAAG CAATCGTTCA TGTCCGTGAT
GACAGTCAGT TAGAGGTCAA AGATACAACA ATTTATGTGG GTGATAAATG GGAAGCAGAA
GATAACTTCG TTTCCGCGAC AGACAAAACA GGTCAAGACG TTCCGTTTGA AAAAATTGAT
GTTCAGGGAA CAGTGAATGT TGATAAAATA GGCGATTATG AAATTGTCTA TAAAAATGGC
ACAAAAGAAG CGAAAGCAAT CGTTCATGTC CGTGATGATA GTCGTTTACA AGTCAAGGAT
ACAACGATTT ATGTCGGCGA TTCNTGGANA CCAGAACNCA ACTTTGTTTC AGCNACAGAT
AAAACAGGTC AAGATGTCCC ATTC
```

EF104-4 (SEQ ID NO:404)
VTTTEAQE TTDTAKKEAE LSNSTPSLPL
ATTTTSEMNQ PTATTESQTT EASTTASSDA ATPSEQQTTE DKDTSLNEKA LPDVQAPITD
ELLDSMSLAP IGGTEYSQTE VHRELNTTPV TATFQFAVGN TGYAPGSVYT VQLPEHLGYS
TVSGEVTGIG ATWAVDAATK TLSITFNQRV SDTSFKVELK SYLTTEAEPL IKIETPGKNK
KTYSFDLYEQ VEPIQYNERT RTTGLDGEIF YNLDRTLTGN QTLELLTTET PGAVFGKQDN
LEPQVFSYDV DINGQILPET QTLLTPGKDY TLSDNSLGRI AVTVPNMQQ KAYSLSINRT
IYLESASDYN YLYSQQYPTT KIGSISLKST TGTKQTTDFT AKTSQTSKVI ADREMRSMSY
ISFQSKGKYY VTIYGTLTET KVGQQIVLES TNGQEIKNPK FTAYGPLYEN VKLEDYFDIK
TEGGKLTLTA TKDSYLRINI SDLTMDFDKK DINLSLSTPV IGPNKAIQLV SDQYIEPISV
VNPLNAETAW GNYDQNGAYS SRTTVSVMGS KEKPIQNLEI KVKHPNYLSL RATKEIYFYY
KLGTDYTVTP TSDGSVIKFT TPITNEIQIP IGFNYVPDSL PKDKSIPVDT IPITMSAEGL
TPVDTTVTTN SKRGSERTLQ SSKNQFLVNA RNDSFDSLSV RTKIPAGADV LFDIYDVSND
QVDSIYPQYW DRGQYFDKPM TPNSPGYPTI TFDENTNSYT FDFGKTNKRY IIEYKNANGW
IDVPTLYITG TAKEPQSNNN EGSASVSVQN EALDILSATQ AANPTLKNVT KTTVTTKNID
NKTHRVKNPT IELTPKGTTN AQIDLNSITV KGVPEDAYSL EKTTNGAKVI FKDYTLTENI
TIEYNTVSAN AGQIYTETTI DSETLNQMSA SKKKVTTAPI TLKFSEGDAE GIVYLATATF
YTHNVEDENQ AIAKVSFELI DNVTHTATEF TTDEKGQYSF DAIMTGDYTL RVTNVPQEYS
VDEEYLTGKA IKLVKGDNQL KIPLTKTIDH SRLQVKDSTI YVGDSWKPEE NFVSATDKTG
QDVPFEKITV SGQVDNXKAG VYPIIYSDEG KEETAYVTVK PDQSKLEVKD TTIYVGDSWK
PEDNFVSATD KTGQDVPFEK IDVQGTVNVD KIGDYEIVYK NGXKEAKAIV HVRDDSQLEV
KDTTIYVGDS WKPEDNFVSA TDKTGQDVPF EKITVSGQVD TSKAGVYPIV YSYEGKEETA
NVTVKPDQSK LEVKDTTIYV GDKWEPEDNF VSATDKTGQD VPFEKIDVQG TVNVDKIGDY
EIVYKNGTKE AKAIVHVRDD SQLEVKDTTI YVGDKWEAED NFVSATDKTG QDVPFEKIDV
QGTVNVDKIG DYEIVYKNGT KEAKAIVHVR DDSRLQVKDT TIYVGDSWXP EXNFVSATDK
TGQDVPF

EF105-1 (SEQ ID NO:405)
TAAATGAAAA AAACAGTCGT CTACTCCTTG TTATTCGGAA CAATGTTGCT TGGCGCCACT
GTTCCTGCTG AAGCGGCGAC GGTCGTTTTT GATAGCGAAC AGTCGATTGT TTTTACCCCA
AGCACAGATG GGACGGATCC AGTAAATCCA GAAAATCCCG ATCCAGAAAA ACCAGTTCGA
CCAGTCGATC CAACGAATCC TGATGGACCT AATCCAGGTA CCCCTGGTCC ACTTTCCATC
GATTATGCCT CAAGTTTGGA TTTTGGGAGT AATGAGATAT CGAATAAGGA TCAAACGTAT
TTTGCCAGAG CGCAAACCTA TAGAAATCCA GGTTCAG CAAGTGAATT GGCAACTGCT
AATTATGTAC AAGTAAGTGA TTTACGGGGA ACCAATGCTG GCTGGGTTTT AAAAGTGAAA
CAAAATGGTC AATTTCGTAA TGCAGAAACA TTACACAAAG AATTAACAGG CGCCACCGTC
GCCTTTACTG AGCCCAGTGT TCGCTCAAAT GCGACGGACG TATTGCCGCC AACTGCTACC
GCAAACATTC AATTAGATGC TGCGGGCGCA GAAACTGTTG TCATGCAAGC CCCAGAAAAG
ACCGGCGCCG GAACGTGGAT CACGCTGTGG GGGCAAGCAG AAAAAGTGAC CGAAAAAAAT
CAACAAGGAC AGCAAGTAAA TGCCACAATC ACACGGGCAA TCTCACTAAC TGTTCCTGGG
AAAACCCCTA AGGATGCAGT ACAATATAAA CAACATTGA CTTGGCTACT TTCAGATGTA
CCAGTAAATA ATGGAGGGAA ATAA

EF105-2 (SEQ ID NO:406)
MKKTVVYSLL FGTMLLGATV PAEAATVVFD SEQSIVFTPS TDGTDPVNPE NPDPEKPVRP
VDPTNPDGPN PGTPGPLSID YASSLDFGSN EISNKDQTYF ARAQTYRNPD GSASELATAN
YVQVSDLRGT NAGWVLKVKQ NGQFRNAETL HKELTGATVA FTEPSVRSNA TDVLPPTATA
NIQLDAAGAE TVVMQAPEKT GAGTWITLWG QAEKVTEKNQ QGQQVNATIT RAISLTVPGK
TPKDAVQYKT TLTWLLSDVP VNNGGK

EF105-3 (SEQ ID NO:407)
GGCGAC GGTCGTTTTT GATAGCGAAC AGTCGATTGT TTTTACCCCA

TABLE 1-continued

Nucleotide and Amino Acid Seqeuences of E. faecalis Genes.

```
AGCACAGATG GGACGGATCC AGTAAATCCA GAAAATCCCG ATCCAGAAAA ACCAGTTCGA
CCAGTCGATC AACGAATCC TGATGGACCT AATCCAGGTA CCCCTGGTCC ACTTTCCATC
GATTATGCCT CAAGTTTGGA TTTTGGGAGT AATGAGATAT CGAATAAGGA TCAAACGTAT
TTTGCCAGAG CGCAAACCTA TAGAAATCCA GATGGTTCAT CAATGTAATT GGCAACTGCT
AATTATGTAC AAGTAAGTGA TTTACGGGGA ACCAATGCTG GCTGGGTTTT AAAAGTGAAA
CAAAATGGTC AATTTCGTAA TGCAGAAACA TTACACAAAG AATTAACAGG CGCCACCGTC
GCCTTTACTG AGCCCAGTGT TCGCTCAAAT GCGACGGACG TATTGCCGCC AACTGCTACC
GCAAACATTC AATTAGATGC TGCGGGCGCA GAAACTGTTG TCATGCAAGC CCCAGAAAAG
ACCGGCGCCG GAACGTGGAT CACGCTGTGG GGGACCGCAG AAAAAGTGAC CGAAAAAAAT
CAACAAGGAC AGCAAGTAAA TGCCACAATC ACACGGGCAA TCTCACTAAC TGTTCCTGGG
AAAACCCCTA AGGATGCAGT AC

EF105-4 (SEQ ID NO:408)
ATVVFD SEQSIVFTPS TDGTDPVNPE NPDPEKPVPR
VDPTNPDGPN PGTPGPLSID YASSLDFGSN EISNKDQTYF ARAQTYRNPD GSASELATAN
YVQVSDLRGT NAGWVLKVKQ NGQFRNAETL HKELTGATVA FTEPSVRSNA TDVLPPTATA
NIQLDAAGAE TVVMQAPEKT GAGTWITLWG QAEKVTEKNQ QGQQVNATIT RAISLTVPGK
TPKDAV

EF106-1 (SEQ ID NO:409)
TAGTCGTTTA TGAAGAAAAA AATCGTTGGT ACAATTACGT TGTTGGCTTT AAGTGCGTTA
TTAGTTGGTG GAGCAGGAGG GGCTTTGACG GCAGAAGCAT ACGTTCCTCA AAGCGTAGAC
AATCCCAATA ATTTAGGGGA TTTACCTGAG TATTTACGTT CAGTTGGTAT TAGACAAGAT
GAAGGATTAT CAGAAAAAGA TTGGGCTGGA ACACGCGTTT ATGATCGAAA TGGGAATGAC
TTAACAGATG AAAATCAAAA CCTATTACAT GCAATCAAAT TTGATGCAAC CACTAGTTTC
TATGAATTTT TTGATAAAGA GACTGGAGAA TCAACAGGAG ATGAAGGAAC CTTCTTTATG
ACCGCTGGTA TTACAGATGT TTCCCGTCTT GTAATTATTT CTGAAACCAA AAATTATCAA
GGTGTATACC CACTTAGAAC TTTATACCAA GATACTTTTA CGTATAGACA GATGGGGAAA
GATAAAAACG GAAATGATAT TGAAGTTTTC GTAGAAAACA AAGCAACCTC AGGACCAGTT
TATGGTCGTC CGCAGCCATA CCCCAATAAT CGTCCCAGAA CACTAGAATT CACGAATGGA
CGCCGTGCCA TGACAGAACA AACAGGCCAG ATTGATGTAA ATCGACAAGG GGATGAAATT
ATTGGTAAAA CTTCCTTTGA TGGGACACCG CAACTTCTTT GGAATGGCAC AAAAGTAGTG
GATAAAGATG GCAATGACGT AACTTCGGCC AACCAAAACT TTATCAGCTT AGCGAAATTT
GACCAAGATA GCAGCAAATA TGAATTTTTC AATTTACAAA CTGGTGAAAC TCGTGGCGAC
TATGGCTACT TTAAAGTAGG AAATCAAAAT AAATTCCGTG CCCATGTTTC CATTGGAACC
AATCGCTATG GCGCTGTCTT AGAGTTAACA GAATTGAATG ATAATCGTTT TACGTACACA
CGAATGGGTA AAGATAACGA AGGAAACGAT ATCCAAGTCT ATGTGGAACA TGAACCATAC
CAAGGAACTT TTAATCCTGA ATTTACCTTT TAA

EF106-2 (SEQ ID NO:410)
MKKKIVGT ITLLALSALL VGGAGGALTA EAYVPQSVDN PNNLGLPEY LRSVGIRQDE
GLSEKDWAGT RVYDRNGNDL TDENQNLLHA IKFDATTSFY EFFDKETGES TGDEGTFFMT
AGITDVSRLV IISETKNYQG VYPLRTLYQD TFTYRQMGKD KNGNDIEVFV ENKATSGPVY
GRPQPYPNNR PRTLEFTNGR RAMTEQTGQI DVNRQGDEII GKTSFDGTPQ LLWNGTKVVD
KDGNDVTSAN QNFISLAKFD QDSSKYEFFN LQTGETRGDY GYFKVGNQNK FRAHVSIGTN
RYGAVLELTE LNDNRFTYTR MGKDNEGNDI QVYVEHEPYQ GTFNPEFTF

EF106-3 (SEQ ID NO:411)
AT ACGTTCCTCA AAGCGTAGAC
AATCCCAATA ATTTAGGGGA TTTACCTGAG TATTTACGTT CAGTTGGTAT TAGACAAGAT
GAAGGATTAT CAGAAAAAGA TTGGGCTGGA ACACGCGTTT ATGATCGAAA TGGGAATGAC
TTAACAGATG AAAATCAAAA CCTATTACAT GCAATCAAAT TTGATGCAAC CACTAGTTTC
TATGAATTTT TTGATAAAGA GACTGGAGAA TCAACAGGAG ATGAAGGAAC CTTCTTTATG
ACCGCTGGTA TTACAGATGT TTCCCGTCTT GTAATTATTT CTGAAACCAA AAATTATCAA
GGTGTATACC CACTTAGAAC TTTATACCAA GATACTTTTA CGTATAGACA GATGGGGAAA
GATAAAAACG GAAATGATAT TGAAGTTTTC GTAGAAAACA AAGCAACCTC AGGACCAGTT
TATGGTCGTC CGCAGCCATA CCCCAATAAT CGTCCCAGAA CACTAGAATT CACGAATGGA
CGCCGTGCCA TGACAGAACA AACAGGCCAG ATTGATGTAA ATCGACAAGG GGATGAAATT
ATTGGTAAAA CTTCCTTTGA TGGGACACCG CAACTTCTTT GGAATGGCAC AAAAGTAGTG
GATAAAGATG GCAATGACGT AACTTCGGCC AACCAAAACT TTATCAGCTT AGCGAAATTT
GACCAAGATA GCAGCAAATA TGAATTTTTC AATTTACAAA CTGGTGAAAC TCGTGGCGAC
TATGGCTACT TTAAAGTAGG AAATCAAAAT AAATTCCGTG CCCATGTTTC CATTGGAACC
AATCGCTATG GCGCTGTCTT AGAGTTAACA GAATTGAATG ATAATCGTTT TACGTACACA
CGAATGGGTA AAGATAACGA AGGAAACGAT ATCCAAGTCT ATGTGGAACA TGAACCATAC
CAAGGAACTT

EF106-4 (SEQ ID NO:412)
YVPQSVDN PNNLGDLPEY LRSVGIRQDE
GLSEKDWAGT RVYDRNGNDL TDENQNLLHA IKFDATTSFY EFFDKETGES TGDEGTFFMT
AGITDVSRLV IISETKNYQG VYPLRTLYQD TFTYRQMGKD KNGNDIEVFV ENKATSGPVY
GRPQPYPNNR PRTLEFTNGR RAMTEQTGQI DVNRQGDEII GKTSFDGTPQ LLWNGTKVVD
KDGNDVTSAN QNFISLAKFD QDSSKYEFFN LQTGETRGDY GYFKVGNQNK FRAHVSIGTN
RYGAVLELTE LNDNRFTYTR MGKDNEGNDI QVYVEHEPYQ GT

EF107-1 (SEQ ID NO:413)
TAAAAAACGG CACTCAATAT GTCAAAATTT GAAATTTCAA GCTGTGTGTT CTTTGGTAAA
ATANATANAA AAATGCTAGT TATCAGTATC GATAATAACA GGATACTGAT TAAGAAAGGA
```

TABLE 1-continued

Nucleotide and Amino Acid Seqeuences of E. faecalis Genes.

```
CTTTATAGAG ACTATAGATT GAATTTTTAC ATAGAAAGAA GGAGCAAGAT GAAGCGAGTA
AATTGGAAAA GATGGCTAGT TGTTGGGTTA AGTTGTTCTT TGTTCATGGA TTCAGTGGTT
GGTGTGACTG TGTTAGCGGA AACGATTACT GGGGCGACGG AGCAAGGAGT AGCAACATCT
CAGTCGAGTG ACGAAGCGAG CCAGACGACG CAAACAACCG AAGAGTCACA GGCAACGGTC
GCTAGTGAAG CGAAAACAGT ACCGCCACAG GAAACGGCAA GAATTGCTTC TCGAGCGATT
GGTTATTCTT CTGTGGAAGG GCGCGAGATT CCCTTTTTCT TTGTGGAGGA AGACGGGACG
TTGTTTGATC CCGACCGAAT TACGATGGCG GTCAATCTTT CCACGTTTTC GTTTTATGAA
GAGAAATTAC AACGAACCCC CCTTGAGCCC ACCACTGTGA ATGGCGGAAA GTTACTGTCT
ATTCCAACGT CACCAGCTTT TAAATATGAT ACAAATAACC AAGAATCCAA TAATATTTAT
GGCGTTTCTG AAGTGTCGTT TACTATTCCT AAGGAGTATC AAAGCCTGGA CATTCGACCA
AGTACGTTTT ATACAGGAGA CACTACGCAA TATCCAGTGC CAACGGTTTT TGCGAACGTT
GGGGGCAAAG TGACGAACTA TGTGGGCGCC AATGCGGAGA CGGAATTAGA GTTAACCAAT
GAAAAAATGC CCAATAAGCT GACGTTTGGT CCTAAAAAGA CGTTTAAATA TACGGTAGCT
ACGGCACCAG GAGGCGTTAC GTATGCGCTG ACCTATTTTT ATGGAGATGT CGGCGGTCCA
ACTAGTTCGC ACCAAAGACG AGGAACAGCG GGTCCTGTGT ATTATTATTT AACAAAGCGG
CGTGTCACGG AAAAATTTGA GAATCCCGCA GGCGGGGCGA TTCCTGCGCC AGAAGGTTAT
ACGCAGGATA AGAAAACCAT TGTAACAGGG GAGGATTTTA CTTTTACCCA AGAAGGCACC
TTGCCTGAAC GTTACACAGG CAGTGATGGG AAGACGTATT TATTTAAAGG TTGGTACAAA
GGGAATGCGA AACCTAGCAC GTTGGAAACC ACCAAAACGC CTAGTTATGC GGTGACCTAT
GATGACAATG ACGATTTGCA TGTGGTCTAT GAAGAAGCAG TGATGAAAAC CTATACGTTG
CCAGCGAGAG AAGCTTTGTT CGGCTATGTT GATGAGCAAG GAAACTTGAT TAATCCCGCC
AAGTTTAAGC TAAGTGCGAC CATGGGTGAA AGTGACGGAG CCACAGGGGA AATGACGACT
TTTCCCACAA TTGATGGAAT CGATATGCCA GCAAGTCAAT TAAAGAAATT AGCCATCCCG
CAAAAAGTCT ACACACGCCC AGACGATGGG ACAATCGTAA CTTATGGCCC GCAAGAAGTG
AGTGTTGAAA TTCCTAAGTA TTACCAGACG ATTTCGATTT CACCAACTAC TGCGTATACA
GGGGATAAAA CCAAGTATCC AGTACCAAAT GAAGTGCGCC GTGGCATCGA AAACCCCGAC
AACATTGTTA GTAGTTTAGT GGGAANCNCT GCGTATAACT TGACCCAAAA AAGTGCCACA
CGCTATACTG CCCGCCGTTC TTACTGGANG TGGGGCCCCA CGAAGACACT TTACTCAATG
AGTATCTATT CAGGAACTGC TGGGGGCAAC TATAATTTAT CGACCCCTGA TGGCACCATT
TATTATTACT TAGAAAATCG GCGGGTCACT GAACATTTTG TAGACGAAAG TGGCGCAAAA
ATCACGCCAC CAACTGGCTT TACACAAGGA AATCAGCTAG TGGTGGACAG TGAAAACTAT
GTCTACACTG TCGCAAAAGC TTTGCCGAAG ATCTACCAAG CTGGTGAAAA AACCTATATC
TTCCAAGGCT GGTTTAAAGG CAAAACCAAG CCAGCAACAT TAAAGACGAC AACGACCCCA
AGTTTTACAC CAACTTTTAA TGATGAGGAC GACATGACCG CTGTGTACCA AGAAGCGATT
CCCACCGCGG AACTAACGTT AACAGGTGCC GTTGACATAA TCGAAAATGG CGCCACAATG
GATTACTGGG AGGCGCTACT AGGAGGCACA GGCGAAGCGC CGTTAACCAC CATTAAAATC
AAGCCAACGG CAACTTGGGC GGCTGGCATC GGCGCACCCA ACACGATATT TGTACAAGGA
ACGGGTCAAA ACACCAAAGC TTTTCCTGTC ACCAAAGAAC AATGGACGAC CGGTGCAGGA
GTGTCCATCA CGTTGGATCA GCCTTTACCA GCTGGCGGTC AATTAAAAAT GAACTTATTA
GGAACCGCCG TTACAGGAAA TCCTGGTCAA GTTTTAACCG CTGATGTTGA AGTAACGGGC
AACTTTGCGA GTTTAACTGC CAAAGATACG GTCCGTATTA AAGACTTAGA TCAAGAAATT
ACGAGTCCTG ACGGCGACGG CTTTATTAGT ACCCGACAT TGATTTTGG TAAACTAGCA
ATTTCAGGAA GTAAGCAACA ATATGGTTTG AAGAAGGCCG CAGATTACTA CGGCAATGGC
ACTCGCAACC CTTATTTACG CCTGAATACT AGCCAAGCCA ATTGGAGTTT AACGGCCCAT
CTATCGCAAC CAAAATCAGC CACAGACAGC TTGCCAACAA CGACCCGCTT GTTGCTAGGA
ACGGCCGCTG CTGCCAGCTT TACCGATTAC AACCAACCAA CAGAAACCAG GACACCACTT
GGCAATACCA GCACCGTGAC TTTAACCGCC GACAATACCG CAACAGCCGT GGTCGCAAAC
CAACAGTTCA CAGGCAGTGA CGTCTATCAG TTGGACTTCA CGTTTGCTAA CAGCAAACTA
GAAGTGCCAG CCAACCAAGG TATGGCTGGC CAACAATACC AAGCCGCCGT CACGTGGAAT
TTAGTGACTG GCCCCTAA
```

EF107-2 (SEQ ID NO:414)
MKRVN
WKRWLVVGLS CSLFMDSVVG VTVLAETITG ATEQGVATSQ SSDEASQTTQ TTEESQATVA
SEAKTVPPQE TARIASRAIG YSSVEGREIP FFFVEEDGTL FDPDRITMAV NLSTFSFYEE
KLQRTPLEPT TVNGGKLLSI PTSPAFKYDT NNQNPSNIYG VSEVSFTIPK EYQSLDIRPS
TFYTGDTTQY PVPTVFANVG GKVTNYVGAN AETELELTNE KMPNKLTFGP KKTFKYTVAT
APGGVTYALT YFYGDVGGPT SSHQRRGTAG PVYYYLTKRR VTEKFENPAG GAIPAPEGYT
QDKKTIVTGE DFTFTQEGTL PERYTGSDGK TYLFKGWYKG NAKPSTLETT KTPSYAVTYD
DNDDLHVVYE EAVMKTYTLP AREALFGYVD EQGNLINPAK FKLSATMGES DGATGEMTTF
PTIDGIDMPA SQLKKLAIPQ KVYTRPDDGT IVTYGPQEVS VEIPKYYQTI SISPTTAYTG
DKTKYPVPNE VRRGIENPDN IVSSLVGXXA YNLTQKSATR YTARRSYWXW GPTKTLYSMS
IYSGTAGGNY NLSTPDGTIY YYLENRRVTE HFVDESGAKI TPPTGFTQGN QLVVDSENYV
YTVAKALPKI YQAGEKTYIF QGWFKGKTKP ATLKTTTTPS FTPTFNDEDD MTAVYQEAIP
TAELTLTGAV DIIENGATMD YWEALLKNTG EAPLTTIKIK PTATWAAGIG APNTIFVQGT
GQNTKAFPVT KEQWTTGAGV SITLDQPLPA GGQLKMNLLG TAVTGNPGQV LTADVEVTGN
FGSLTAKDTV RIKDLDQEIT SPDGDGFIST PTFDFGKLAI SGSKQQYGLK KAADYYGNGT
RNPYLRLNTS QANWSLTAQL SQPKSATDSL PTTTRLLLGT AAAASFTDYN QPTETRTPLG
KTSTVTLTAD NTATAVVANQ QFTGSDVYQL DFTFANIKLE VPANQGMAGQ QYQAAVTWNL
VTGP

EF107-3 (SEQ ID NO:415)
GG AGCAAGGAGT AGCAACATCT
CAGTCGAGTG ACGAAGCGAG CCAGACGACG CAAACAACCG AAGAGTCACA GGCAACGGTC
GCTAGTGAAG CGAAAACAGT ACCGCCACAG GAAACGGCAA GAATTGCTTC TCGAGCGATT
GGTTATTCTT CTGTGGAAGG GCGCGAGATT CCCTTTTTCT TTGTGGAGGA AGACGGGACG
TTGTTTGATC CCGACCGAAT TACGATGGCG GTCAATCTTT CCACGTTTTC GTTTTATGAA

TABLE 1-continued

Nucleotide and Amino Acid Seqeuences of E. faecalis Genes.

```
GAGAAATTAC AACGAACCCC CCTTGAGCCC ACCACTGTGA ATGGCGGAAA GTTACTGTCT
ATTCCAACGT CACCAGCTTT TAAATATGAT ACAAATAACC AGAATCCAAG TAATATTTAT
GGCGTTTCTG AAGTGTCGTT TACTATTCCT AAGGAGTATC AAAGCCTGGA CATTCGACCA
AGTACGTTTT ATACAGGAGA CACTACGCAA TATCCAGTGC CAACGGTTTT TGCGAACGTT
GGGGGCAAAG TGACGAACTA TGTGGGCGCC AATGCGGAGA CGGAATTAGA GTTAACCAAT
GAAAAAATGC CCAATAAGCT GACGTTTGGT CCTAAAAAGA CGTTTAAATA TACGGTAGCT
ACGGCACCAG GAGGCGTTAC GTATGCGCTG ACCTATTTTT ATGGAGATGT CGGCGGTCCA
ACTAGTTCGC ACCAAAGACG AGGAACAGCG GGTCCTGTGT ATTATTATTT AACAAAGCGG
CGTGTCACGG AAAAATTTGA GAATCCCGCA GGCGGGGCGA TTCCTGCGCC AGAAGGTTAT
ACGCAGGATA AGAAAACCAT TGTAACAGGG GAGGATTTTA CTTTTACCCA AGAAGGCACC
TTGCCTGAAC GTTACACAGG CAGTGATGGG AAGACGTATT TATTTAAAGG TTGGTACAAA
GGGAATGCGA AACCTAGCAC GTTGGAAACC ACCAAAACGC CTAGTTATGC GGTGACCTAT
GATGACAATG ACGATTTGCA TGTGGTCTAT GAAGAAGCAG TGATGAAAAC CTATACGTTG
CCAGCGAGAG AAGCTTTGTT CGGCTATGTT GATGAGCAAG GAAACTTGAT TAATCCCGCC
AAGTTTAAGC TAAGTGCGAC CATGGGTGAA AGTGACGGAG CCACAGGGGA AATGACGACT
TTTCCCCACAA TTGATGGAAT CGATATGCCA GCAAGTCAAT TAAAGAAATT AGCCATCCCG
CAAAAAGTCT ACACACGCCC AGACGATGGG ACAATCGTAA CTTATGGCCC GCAAGAAGTG
AGTGTTGAAA TTCCTAAGTA TTACCAGACG ATTTCGATTT CACCAACTAC TGCGTATACA
GGGGATAAAA CCAAGTATCC AGTACCAAAT GAAGTGCGCC GTGGCATCGA AAACCCCGAC
AACATTGTTA GTAGTTTAGT GGGAANCNCT GCGTATAACT TGACCCAAAA AAGTGCCACA
CGCTATACTG CCCGCCGTTC TTACTGGANG TGGGGCCCCA CGAAGCACT TTACTCAATG
AGTATCTATT CAGGAACTGC TGGGGGCAAC TATAATTTAT CGACCCCTGA TGGCACCATT
TATTATTACT TAGAAAATCG GCGGGTCACT GAACATTTTG TAGACGAAAG TGGCGCAAAA
ATCACGCCAC CAACTGGCTT TACACAAGGA AATCAGCTAG TGGTGGACAG TGAAAACTAT
GTCTACACTG TCGCAAAAGC TTTGCCGAAG ATCTACCAAG CTGGTGAAAA AACCTATATC
TTCCAAGGCT GGTTTAAAGG CAAAACCAAG CCAGCAACAT TAAAGACGAC AACGACCCCA
AGTTTTACAC CAACTTTTAA TGATGAGGAC GACATGACCG CTGTGTACCA AGAAGCGATT
CCCACCGCGG AACTAACGTT AACAGGTGCC GTTGACATAA TCGAAAATGG CGCCACAATG
GATTACGTTT AGGCGCTACT GAAGAACACA GGCGAAGCGC CGTTAACCAC CATTAAAATC
AAGCCAACGG CAACTTGGGC GGCTGGCATC GGCGCACCCA ACACGATATT TGTACAAGGA
ACGGGTCAAA ACACCAAAGC TTTTCCTGTC ACCAAAGAAC AATGGACGAC CGGTGCAGGA
GTGTCCATCA CGTTGGATCA GCCTTTACCA GCTGGCGGTC AATTAAAAAT GAACTTATTA
GGAACCGCCG TTACAGGAAA TCCTGGTCAA GTTTTAACCG CTGATGTTGA AGTAACGGGC
AACTTTGGCA GTTTAACTGC CAAAGATACG GTCCGTATTA AAGACTTAGA TCAAGAAATT
ACGACTCCTG ACGGCGACGG CTTTATTAGT ACCCCGACAT TGATTTTGG TAAACTAGCA
ATTTCAGGAA GTAAGCAACA ATATGGTTTG AAGAAGGCCG CAGATTACTA CGGCAATGGC
ACTCGCAACC CTTATTTACG CCTGAATACT AGCCAAGCCA ATTGGAGTTT AACGGCCCAG
CTATCGCAAC CAAAATCAGC CACAGACAGC TTGCCAACAA CGACCCGCTT GTTGCTACCA
ACGGCCGCTG CTGCCAGCTT TACCGATTAC AACCAACCAA CAGAAACCAG GACACCACTT
GGCAAGACCA GCACCGTGAC TTTAACCGCC GACAATACCG CAACAGCGGT GGTCGCAAAC
CAACAGTTCA CAGGCAGTGA CGTCTATCAG TTGGACTTCA CGTTTGCTAA CATCAAACTA
GAAGTGCCAG CCAACCAAGG TATGGCTGGC AACAATACC AAGCCGCCGT CACGTGGAAT
TTAGTGACTG GCCCCT

EF107-4 (SEQ ID NO:416)
EQGVATSQ SSDEASQTTQ TTEESQATVA
SEAKTVPPQE TARIASRAIG YSSVEGREIP FFFVEEDGTL FDPDRITMAV NLSTFSFYEE
KLQRTPLEPT TVNGGKLLSI PTSPAFKYDT NNQNPSNIYG VSEVSFTIPK EYQSLDIRPS
TFYTGDTTQY PVPTVFANVG GKVTNYVGAN AETELELTNE KMPNKLTFGP KKTFKYTVAT
APGGVTYALT YFYGDVGGPT SSHQRRGTAG PVYYYLTKRR VTEKFENPAG GAIPAPEGYT
QDKKTIVTGE DFTFTQEGTL PERYTGSDGK TYLFKGWYKG NAKPSTLETT KTPSYAVTYD
DNDDLHVVYE EAVMKTYTLP AREALFGYVD EQGNLINPAK FKLSATMGES DGATGEMTTF
PTIDGIDMPA SQLKKLAIPQ KVYTRPDDGT IVTYGPQEVS VEIPKYYQTI SISPTTAYTG
DKTKYPVPNE VRRGIENPDN IVSSLVGXXA YNLTQKSATR YTARRSYWXW GPTKTLYSMS
IYSGTAGGNY NLSTPDGTIY YYLENRRVTE HFVDESGAKI TPPTGFTQGN QLVVDSENYV
YTVAKALPKI YQAGEKTYIF QGWFKGKTKP ATLKTTTTPS FTPTFNDEDD MTAVYQEAIP
TAELTLTGAV DIIENGATMD YWEALLKNTG EAPLTTIKIK PTATWAAGIG APNTIFVQGT
GQNTKAFPVT KEQWTTGAGV SITLDQPLPA GGQLKMNLLG TAVTGNPGQV LTADVEVTGN
FGSLTAKDTV RIKDLDQEIT SPDGDGFIST PTFDFGKLAI SGSKQQYGLK KAADYYGNGT
RNPYLRLNTS QANWSLTAQL SQPKSATDSL PTTTRLLLGT AAAASFTDYN QPTETRTPLG
KTSTVTLTAD NTATAVVANQ QFTGSDVYQL DFTFANIKLE VPANQGMAGQ QYQAAVTWNL
VTGP

EF108-1 (SEQ ID NO:417)
TAATCGGTTT GGCGGGAATC GTACATAGAA AGAAGGGACG ACATGAAGCA AACTAAGTGG
CAACGATTAG CAACCATTGG CTTGTGTAGT TCTTTAGTAA TTAACGCCTT TTCTGGTGTG
ACGGCAGTTG CGGAAACCGT GACGATTGAA AGTAGTCCGA CCGCCGAAAG TAGTGCCAAG
GAAGAGACGC AAGCAAGTAG CGTGAAGGAA GAAACAACGA AAGCCAGTAC GGAAAATAGT
CAAGTAACAA CTGACACGAG TCAGGAAGAA GCAACGAAAG AAGCGGAGAA AGAAGAACCG
CAAGCAGAAC TGGAACAAGC AGAAACACCA ATCATTCCTA AACCAAAAAA AATCAATATG
AAGGCAACTT ATTCATTTTC TGCAGAAACT TATCAGTTTG GATTTGTGAA TGAATCAGGT
CAATTAATAA ATCCAGATAT TATACCAATT ACGTATAGCT ATGCCAAAGG ATCATGGAAG
ACAGATGGTT ATAATCGAAA GTGGACTAGT ATGGTTCAAG GGAGTGCTTC AACCGTAGGA
AACTTAAAGA ATGTAATAAT GCCAGCAAGT TCTGTAGTTA TGCCACCAGG ACCGTCATAT
GAAGGAACTC AAGAGGTGTA CACAAACTTT TCAATTCGCA TACCAAAATA TTATGCATCA
GCGAGTCTCT ACAATAGAGA AGGTAAAATT GATTCTACTT ATCCGTTACC TGCTATTGCA
CTAGCAGGTA CTAGACCGCT ATCTTTGACT CAAAGTAGTG TAATTAGTGC ATTGGCGCTG
```

TABLE 1-continued

Nucleotide and Amino Acid Seqeuences of *E. faecalis* Genes.

```
ACCAGTAAAG GAGACAATGT TTATACACCA CGGGAAACAT TTTTTGGAGG AGATCCTGCA
GGTGTAAAGT TTACTAATTT TTTGTATCGT ATAAATGACT TTGATGTGAA AGGTAATAAC
ATAGGTTATA AGACTGTGAG TAGCCCAATC TATTAGGATC TGACCAACCG CCGTGTCACC
GAAAACTTCG TAGATACAAG TGGCGCCAAA ATCACGCCAA CAAGTAATTT CACCCAAGGG
AAACAAACGG TCATTAACAG TGATCCTTAC ACGTTCCAAC AAAGTGGTTT TTTACCCGAG
ACCTACAAAG TTGGCACGAA ATCTTACCGA TTCAAAGGCT GGTACAAAGG GAAAACCAAA
ACCGAGCCTT TGGCCACCAC TAAAACACCT AGCTATAAAG TCACGTATGA TGACAATGAT
GATTTGACGG TGGTCTATGA GGAGTTTTCA GGGTACGAGC TGCCTGCTTC GACCAATCAA
TTTGGCTTTG TGGATGAAGC GACGAACAAA TTAATTGCCC CCGACCAAGT GCAGATGAAG
TATAATCTTA CTTTAAATGA AAATAATAAA AAAACAGTAA TGAGCAGTAA CTTAACGGGG
ACAGATACAG CGACACTGAA AAACTTGTCC GTGCCTGTCA ACTATTTTGA ACAATATCGC
GTCAATACGT TTTATGGCGC GAGTGACATT ACGTTTACAT TGCCCAAACG GTACAAATCA
ATCAATATTA CCAAATCAGA TGGCAAAACC GACCCAGCTT TTCCTCTTCC TAAAATCTAT
AATATAGATC AAGTAGAAAT ATCACACATG CCTGTGACCA CTTATAACAA GTTGAAACAG
CTGTCGGGCC AAACGTTTGG CTTTAATGCT TTAGCCGATC AACCTGAATT TTATACGAAA
ACGTTATTTG GACAGAGTC TGGCATCGAT GACCCAGTCA ATTATTATAC AATGAGTGGC
CCTGTTTACT ATTATTTAGA AAACCGCAAA GTCACCGAGA ACTTCGTAGA CACCAACGGC
GCTAAAATCA CACCGCCAAC AGGTTTCACC CAAGGTAAAA AAACGGTGAT TACAAGCGAC
GCCTACACTT TCAAACAAGC AGGCACCTTA CCAGACACTT ACACAACAGG CGGTAAGACC
TACAAGTTCA AAGGTTGGTA CAAAGGCAAG TCCATACTCA ACACATTGAC AACTACCAAA
GCGCCAAGTT ATCAAGTGAC CTACGATGAC AATGATGATT TGAATGTGGT GTATGAAGAA
GAAACAGTTA CGACAGTGTA TCCATCAGTC GATATGAACT TTGTGAATGA AAAAGGCGGG
GCTTTCACAC CGGCGTTAAC TTTTAGTGGT AAGTACTATG CGCAAAGTAC GAGTGCCGTAC
TTAAGAACCG ATTTATATGA CGTGACCTCA AAAAATAATG GTAATGGGCA ATATACGGTA
AGTATTAATA ATGGTAGTAT GCCATTGTCC CAAGAATTAT TGAAAAAATA TAATAATGGA
CAACCAATCA GTGCTACCAA CAGATTACAG TTTAATGTTG ATAAATTAGC CATCGACCAA
CAACTAAAAT ATGTTGACAG CATTCAATTA GACACAGCTC AAAGTAGCAA TCTGAAATCC
TATAGATATG TGTACACGAA CAATACGTCA CTGGTTTTCG ACCCAAATGT AGCACCAGCA
GAGGTTGACC TTAGTTCAGA ATCTCTTAAC TTGCTTAATT TTGATTCAGA TGGCACCTAT
TTTTCTAATG CAAATAATAG ACTTTTTTAC ACGACTTTAG GATATAGTGG CACACCAGGA
GTTAACTATC TTCTCGTAAT GTTTCTTTTT AAGCGGAAAC CTGCCGGATAA GTCAAAACTT
GTCTACAAAG TCACTCGCAA ACAAGTCACC GAAAACTTCG TGGATGTCAA CGGTGCCAAA
ATCACTGCAC CAACAGGCTT CACCCAAGGT AACCAAGTAC CAATGAACAG TAACACCTTC
AAGTACACAG CGGCAAAAGC TTTACCAGCG ACGTATACTA CAGGTGGCAA AGTCTATACG
TTCCAAGGGT GGTATAAAGG GAAAACCAAG CCAAGTACGT TGAACAAAAC AACAACTCCA
ACGTTCAATG CGACCTTTGA TGGCAATGAC GATATGACCG CCATGTATAA GGAAGAAATA
CCAACAGCTA GTGTCACATT AACTCGACCA AAAGAAGTGA TTGATACGAA TACCAATGTA
ATCTGGACAA CAACGATCAC GAATACTAGC AAAGCACCCT TACAAAATCT CACCTTGAAA
AAAGGGCCCA ATTGGTCAGC TGGTCTGACG ATCCCGACCT TTATGGAAGT GACACCAGAA
GGAGAAACGA CAAAATCAAT CCCAGTAAAT AGTACACTTT GGACAGAGGG GGTTCCTTTA
CCAAATGCCG TTCCTATCGG CAAAAAAGTT TCAGTTGCTT TCACAACTCG CGCAACAGGG
AAACCAAACA CTGTTTTGAA AGCAGAAGTT GTAGTATTTG GTGGTATTAA AGATAGTACA
GTGGATAACT TCGTGAGAAT TCGTCCAAAT GATCAAGAAG TAGTCACACC AACGACCGAA
GGCTTCATCA GTGTGCCAAC CTTCGACTTC GGCCAAGTGG GCGTTGCAGG AACTAAGCAA
CAACACAGCT TGAAACAAGC CGCGGATTAC TACGGTAACG GCACACGGAA TCCGTATCTG
CGGATTAAGA AAACGCAACC CAATTGGAGC TTAACAGCGC AACTGTCACA ACCAAAATCA
GCGACAGACA GCTTGCCTAC AGCGACCCGC TTATTATTAG GGGCGGCGCC TGTCTCTAGC
TTTACCAATT ACAATCAACC AACCGAGTTG AAAAATACGG TCGGTACCAC GAGTGCCATT
AGCTTAACAG CCAACAACAC AGCAACGAGT ATTATTGCCA ACAAGCAATT CACAGGTAGT
AATGTTTATC AGTTGGACTT CACCTTCAAT AATGTCAAAC TTGAAGTGCC AGCCAATCAA
GGTGTTAAAG GCAACAATA CAAGGCCGCA GTTACATGGA ACCTAGTTAC AGGTCCTTAA
```

EF108-2 (SEQ ID NO:418)
MKQTKWQ RLATIGLCSS LVINAFSGVT AVAETVTIES SPTAESSAKE
ETQASSVKEE TTKASTENSQ VTTDTSQEEA TKEAEKEEPQ AEVAQAETPI IPKPKKINMK
ATYSFSAETY QFGFVNESGQ LINPDIIPIT YSYAKGSWKT DGYNRKWTSM VQGSASTVGN
LKNVIMPATS VVMPPGPSYE GTQEVYTNFS IRIPKYYASA SLYNREGKID STYPLPAIAL
AGTRPLSLTQ SSVISALALT SKGDNVYTPR ETFFGGDPAG VKFTNFLYRI NDFDVKGNNI
GYKTVSSPIY YHLTNRRVTE NFVDTSGAKI TPPSNFTQGK QTVINSDPYT FQQSGFLPET
YKVGTKSYRF KGWYKGKTKT EPLATTKTPS YKVTYDDNDD LTVVYEEFSG YELPASTNQF
GFVDEATNKL IAPDQVQMKY NLTLNENNKK TVMSSNLTGT DTATLKNLSV PVNYFEQYRV
NTFYGASDIT FTLPKRYKSI NITKSDGKTD PAFPLPKIYN IDQVEMSHMP VTTYNKLKQL
SGQTFGFNAL ADQPEFYTKT LFGTESGIDD PVNYYTMSGP VYYYLENRKV TENFVDTNGA
KITPPTGFTQ GKKTVITSDA YTFKQAGTLP DTYTTGGKTY KFKGWYKGKS ILNTLTTTKA
PSYQVTYDDN DDLNVVYEEE TVTTVYPSVD MNFVNEKGGA FTPALTFSGK YYAQSTSAYL
RTDLYDVTSK NNGNGQYTVS INNGSMPLSQ ELLKKYNNGQ PISATNRLQF NVDKLAIDQQ
LKYVDSIQLD TAQSSNLKSY RYVYTNNSSL VFDPNVAPAE VDLSSESLNL LNFDSDGTYF
SNANNRLFYT HLGYSGTPGV NYLLVMFLFN AKPADKSLV YKVTRKQVTE NFVDVNGAKI
TAPTGFTQGN QVPMNSNTFK YTAAKALPAT YTTGGKVYTF QGWYKGKTKP STLNKTTTPT
FNATFDGNDD MTAMYKEEIP TASVTLTRPK EVIDTNTNVI WTTTITNTSK APLQNLTLKK
GPNWSAGLTI PTFMEVTPEG ETTKSIPVNS TLWTEGVPLP NAVPIGKKVS VAFTTRATGK
PNTVLKAEVV VFGGIKDSTV DNFVRIRPND QEVVTPTTEG FISVPTFDFG QVGVAGTKQQ
HSLKQAADYY GNGTRNPYLR IKKTQPNWSL TAQLSQPKSA TDSLPTATRL LLGAAPVSSF
TNYNQPTELK NTVGTTSAIS LTANNTATSI IANKQFTGSN VYQLDFTFNN VKLEVPANQG
VKGQQYKAAV TWNLVTGP

EF108-3 (SEQ ID NO:419)

TABLE 1-continued

Nucleotide and Amino Acid Seqeuences of E. faecalis Genes.

```
CGT GACGATTGAA AGTAGTCCGA CCGCCGAAAG TAGTGCCAAG
GAAGAGACGC AAGCAAGTAG CGTGAAGGAA GAAACAACGA AAGCCAGTAC GGAAAATAGT
CAAGTAACAA CTGACACGAG TCAGGAAGAA GCAACGAAAG AAGCGGAGAA AGAAGAACCG
CAAGCAGAAG TGGAACAAGC AGAAACACCA ATCATTCCTA AACCAAAAAA AATCAATATG
AAGGCAACTT ATTCATTTTC TGCAGAAACT TATCAGTTTG GATTTGTGAA TGAATCAGGT
CAATTAATAA ATCCAGATAT TATACCAATT TCGTATAGCT ATGCCAAAGG ATCATGGAAG
ACAGATGGTT ATAATCGAAA GTGGACTAGT ATGGTTCAAG GGAGTGCTTC AACCGTAGGA
AACTTAAAGA ATGTAATAAT GCCAGCAACT TCTGTAGTTA TGCCACCAGG ACCGTCATAT
GAAGGAACTC AAGAGGTGTA CACAAACTTT TCAATTCGCA TACCAAAATA TTATGCATCA
GCGAGTCTCT ACAATAGAGA AGGTAAAATT GATTCTACTT ATCCGTTACC TGCTATTGCA
CTAGCAGGTA CTAGACCGCT ATCTTTGACT CAAAGTAGTG TAATTAGTGC ATTGGCGCTG
ACCAGTAAAG GAGACAATGT TTATACACCA CGGGAAACAT TTTTTGGAGG AGATCCTGCA
GGTGTAAAGT TTACTAATTT TTTGTATCGT ATAAATGACT TTGATGTGAA AGGTAATAAC
ATAGGTTATA AGACTGTGAG TAGCCCAATC TATTACCATC TGACCAACCG CCGTGTCACC
GAAAACTTCG TAGATACAAG TGGCGCCAAA ATCACGCCAC AAGTAATTT CACCCAAGGG
AAACAAACGG TCATTAACAG TGATCCTTAC ACGTTCCAAC AAAGTGGTTT TTTACCCGAG
ACCTACAAAG TTGGCACGAA ATCTTACCGA TTCAAAGGCT GGTACAAAGG GAAAACCAAA
ACCGAGCCTT TGGCCACCAC TAAAACACCT AGCTATAAAG TCACGTATGA TGACAATGAT
GATTTGACGG TGGTCTATGA GGAGTTTTCA GGGTACGAGC TGCCTGCTTC GACCAATCAA
TTTGGCTTTG TGGATGAAGC GACGAACAAA TTAATTGCCC CCGACCAAGT GCAGATGAAG
TATAATCTTA CTTTAAATGA AAATAATAAA AAAACAGTAA TGAGCAGTAA CTTAACGGGG
ACAGATACAG CGACACTGAA AAACTTGTCC GTGCCTGTCA ACTATTTTGA ACAATATCGC
GTCAATACGT TTTATGGCGC GAGTGACATT ACGTTTACAT TGCCCAAACG GTACAAATCA
ATCAATATTA CCAAATCAGA TGGCAAAACC GACCCAGCTT TTCCTCTTCC TAAAATCTAT
AATATAGATC AAGTAGAAAT GTCACACATG CCTGTGACCA CTTATAACAA GTTGAAACAG
CTGTCGGGCC AAACGTTTGG CTTTAATGCT TTAGCCGATC AACCTGAATT TTATACGAAA
ACGTTATTTG GACAGAGTC TGGCATCGAT GACCCAGTCA ATTATTATAC ATTGAGTGGC
CCTGTTTACT ATTATTAGA AAACCGCAAA GTCACCAGAG ACTTCGTAGA CACCAACGGC
GCTAAAATCA CACCGCCAAC AGGTTTCACC CAATTGAAAA AAACGGTGAT TACAAGCGAC
GCCTACACTT TCAAACAAGC AGGCACCTTA CCAGACACTT ACACAACAGG CGGTAAGACC
TACAAGTTCA AAGGTTGGTA CAAAGGCAAG TCCATACTCA ACACATTGAC AACTACCAAA
GCGCCAAGTT ATCAAGTGAC CTACGATGAC AATGATGATT TGAATGTGGT GTATGAAGAA
GAAACAGTTA CGACAGTGTA TCCATCAGTC GATATGAACT TTGTGAATGA AAAAGGCGGG
GCTTTCACAC CGGCGTTAAC TTTTAGTGGT AAGTACTATG CGCAAAGTAC GAGTGCGTAC
TTAAGAACCG ATTTATATGA CGTGACCTCA AAAAATAATG GTAATGGGCA ATATACGGTA
AGTATTAATA ATGGTAGTAT GCCATTGTCC CAAGAATTAT TGAAAAAATA TAATAATGGA
CAACCAATCA GTGCTACCAA CAGATTACAG TTTAATGTTG ATAAATTAGC CATCGACCAA
CAACTAAAAT ATGTTGCAG CATTCAATTA GACACAGCTC AAAGTAGCAA TCTGAAATCC
TATAGATATG TGTACACGAA CAATAGCTCA CTGGTTTTCG ACCCAAATGT AGCACCAGCA
GAGGTTGACC TTAGTTCAGA ATCTCTTAAC TTGCTTAATT TTGATTCAGA TGGCACCTAT
TTTTCTAATG CAAATAATAG ACTTTTTTAC ACGCATTTAG GATATAGTGG CACACCAGGA
GTTAACTATG TTCTCGTAAT GTTTCTTTTT AACGCCAAAC CTGCGGATAA GTCAAAACTT
GTCTACAAAG TCACTCGCAA ACAAGTCACC GAAAACTTCG TGGATGTCAA CGGTGCCAAA
ATCACTGCAC CAACAGGCTT CACCCAAGGT AACCAAGTAC AATGAACAG TAACACCTTC
AAGTACACAG CGGCAAAAGC TTTACCAGCG ACGTATACTA CAGGTGGCAA AGTCTATACG
TTCCAAGGGT GGTATAAAGG GAAAACCAAG CCAAGTACGT TGAACAAAAC AACAACTCCA
ACGTTCAATG CGACCTTTGA TGGCAATGAC GATATGACCG CCATGTATAA GGAAGAAATA
CCAACAGCTA GTGTCACATT AACTCGACCA AAAGAAGTGA TTGATACGAA TACCAATGTA
ATCTGGACAA CAACGATCAC GAATACTAGC AAAGCACCCT TACAAAATCT CACCTTGAAA
AAAGGGCCCA ATTGGTCAGC TGGTCTGACG ATCCCGACCT TTATGGAAGT GACACCAGAA
GGAGAAACGA CAAAATCAAT CCCAGTAAAT AGTACACTTT GGACAGAGGG GGTTCCTTTA
CCAAATGCCG TTCCTATCGG CAAAAAAGTT TCAGTTGCTT TCACAACTCG CGCAACAGGG
AAACCAAACA CTGTTTTGAA AGCAGAAGTT GTAGTATTTG GTGGTATTAA AGATAGTACA
GTGGATAACT TCGTGAGAAT TCGTCCAAAT GATCAAGAAG TAGTCACACC AACGACCGAA
GGCTTCATCA GTGTGCCAAC CTTCGACTTC GGCCAAGTGG GCGTTGCAGG AACTAAGCAA
CCCACACGCT TGAAACAAGC CGCGGATTAC TACGGTAACG GCACACGGAA TCCGTATCTG
CGGATTAAGA AAACGCAACC CAATTGGAGC TTAACAGCGC AACTGTCACA ACCAAAATCA
GCGACAGACA GCTTGCCTAC AGCGACCCGC TTATTATTAG GGGCGGCGCC TGTCTCTAGC
TTTACCAATT ACAATCAACC AACCGAGTTG AAAAATACGG TCGGTACCAC GAGTGCCATT
AGCTTAACAG CCAACAACAC AGCAACGAGT ATTATTCCA CAAGCAATT CACAGGTAGT
AATGTTTATC AGTTGGACTT CACCTTCAAT AATGTCAAAC TTGAAGTGCC AGCCAATCAA
GGTGTTAAAG GGCAACAATA CAAGGCCGCA GTTCATGGA ACCTAGTTAC AG
```

EF108-4 (SEQ ID NO:420)
```
VTIES SPTAESSAKE
ETQASSVKEE TTKASTENSQ VTTDTSQEEA TKEAEKEEPQ AEVEQAETPI IPKPKKINMK
ATYSFSAETY QFGFVNESGQ LINPDIIPIT YSYAKGSWKT DGYNRKWTSM VQGSASTVGN
LKNVIMPATS VVMPPGPSYE GTQEVYTNFS IRIPKYYASA SLYNREGKID STYPLPAIAL
AGTRPLSLTQ SSVISALALT SKGDNVYTPR ETFFGGDPAG VKFTNFLYRI NDFDVKGNNI
GYKTVSSPIY YHLTNRRVTE NFVDTSGAKI TPPSNFTQGK QTVINSDPYT FQQSGFLPET
YKVGTKSYRF KGWYKGKTKT EPLATTKTPS YKVTYDDNDD LTVVYEEFSG YELPASTNQF
GFVDEATNKL IAPDQVQMKY NLTLNENNKK TVMSSNLTGT DTATLKNLSV PVNYFEQYRV
NTFYGASDIT FTLPKRYKSI NITKSDGKTD PAFPLPKIYN IDQVEMSHMP VTTYNKLKQL
SGQTFGFNAL ADQPEFYTKT LFGTESGIDD PVNYYTMSGP VYYYLENRKV TENFVDTNGA
KITPPTGFTQ GKKTVITSDA YTFKQAGTLP DTYTTGGKTY KFKGWYKGKS ILNTLTTTKA
PSYQVTYDDN DDLNVVYEEE TVTTVYPSVD MNFVNEKGGA FTPALTFSGK YYAQSTSAYL
RTDLYDVTSK NNGNGQYTVS INNGSMPLSQ ELLKKYNNGQ PISATNRLQF NVDKLAIDQQ
```

TABLE 1-continued

Nucleotide and Amino Acid Seqeuences of E. faecalis Genes.

LKYVDSIQLD TAQSSNLKSY RYVYTNNSSL VFDPNVAPAE VDLSSESLNL LNFDSDGTYF
SNANNRLFYT HLGYSGTPGV NYLLVMFLFN AKPADKSKLV YKVTRKQVTE NFVDVNGAKI
TAPTGFTQGN QVPMNSNTFK YTAAKALPAT YTTGGKVYTF QGWYKGKTKP STLNKTTTPT
FNATFDGNDD MTAMYKEEIP TASVTLTRPK EVIDTNTNVI WTTTITNTSK APLQNLTLKK
GPNWSAGLTI PTFMEVTPEG ETTKSIPVNS TLWTEGVPLP NAVPIGKKVS VAFTTRATGK
PNTVLKAEVV VFGGIKDSTV DNFVRIRPND QEVVTPTTEG FISVPTFDFG QVGVAGTKQQ
HSLKQAADYY GNGTRNPYLR IKKTQPNWSL TAQLSQPKSA TDSLPTATRL LLGAAPVSSF
TNYNQPTELK NTVGTTSAIS LTANNTATSI IANKQFTGSN VYQLDFTFNN VKLEVPANQG
VKGQQYKAAV TWNLVT

EF109-1 (SEQ ID NO:421)
AGGAGTAAAT TAATGAAAAA AAGTGTTATA ACTAGTTCTA TGTTAGCGGT TTTGTTGTCG
GGATTTCTCG TTACCCCTAT TTCTGCTTAC GCTTTGAAC GCTCTAAGGG AACTACTGAA
GAAACGGTGG CTTCAGAAAC ATCTCTAACG GAGCGACAAA TGAGTAGCGG TGTCACTGAA
GAAATGAACC CAAGCATCAT AAATTCTCAA GAGGAAACAG AAACAACGTC CACTTCCTCA
ACCTCCGATT CCACCACTGA AGTTTCTACA TCAGAAGTAA CAACTGTTAA TGATACAGAA
NATAGTAGCG ACGTACTGAA ACTACTTTGG NAACATCACN AAGTAATGAG GACACACCTA
TAG

EF109-2 (SEQ ID NO:422)
MKKSVI TSSMLAVLLS GFLVTPISAY ALERSKGTTE ETVASETSLT ERQMSSGVTE
EMNPSIINSQ EETETTSTSS TSDSTTEVST SEVTTVNDTE XSSDVLKLLW XHHXVMRTHL

EF109-2 (SEQ ID NO:423)
GGAAC GCTCTAAGGG AACTACTGAA
GAAACGGTGG CTTCAGAAAC ATCTCTAACG GAGCGACAAA TGAGTAGCGG TGTCACTGAA
GAAATGAACC CAAGCATCAT AAATTCTCAA GAGGAAACAG AAACAACGTC CACTTCCTCA
ACCTCCGATT CCACCACTGA AGTTTCTACA TCAG

EF109-4 (SEQ ID NO:424)
ERSKGTTE ETVASETSLT ERQMSSGVTE EMNPSIINSQ EETETTSTSS TSDSTTEVST S

EF110-1 (SEQ ID NO:425)
TAAATAAAAA TGGATAAGGA GTGGCATAAT ATTATGAAAA AGTTCTCCAT ACGAAAAATT
AGTGCTGGTT TTTTGTTTCT GATTTTAGTA ACTTTGATCG CCGGTTTTAG CTTGTCTGCA
AATGCAGAAG AGTATATCGT TCCTGCCGAA AGTCATTCAC GACAAAAAAG ATCGTTACTG
GACCCTGAGG ACAGAAGACA AGAAGTGGCA GATACAACCG AAGCGCCTTT TGCGTCAATC
GGAAGAATCA TTTCCCCTGC CAGTAAACCA GGCTATATTT CTTTAGGAAC AGGCTTTGTT
GTTGGAACCA ATACAATTGT CACCAATAAT CATGTGGCTG AAAGTTTTAA GAATGCCAAA
GTATTAAATC CGAATGCCAA AGATGATGCT TGGTTTTATC CAGGTCGAGA TGGCAGTGCG
ACACCATTTG GCAAATTCAA AGTGATTGAT GTAGCTTTTT CCCCGAATGC GGATATTGCG
GTAGTGACTG TCGGCAAACA AAACGATCGT CCAGATGGCC CAGAGTTGGG AGAAATTTTA
ACGCCATTTG TTTTGAAAAA GTTTGAATCT TCAGATACCC ATGTCACAAT ATCAGGCTAT
CCAGGTGAGA AAACCACAC ACAATGGTCT CATGAAAATG ATTTGTTTAC ATCTAACTTT
ACAGACTTAG AAAATCCATT ACTATTTTAT GATATCGATA CAACCGGCGG TCAATCTGGT
TCACCAATCT ATAATGATCA GGTTGAAGTA GTTGGTGTTC ATTCCAATGG CGGCATTAAG
CAAACAGGAA ATCATGGTCA AAGACTAAAT GAAGTGAATT ATAACTTTAT TGTTAATCGA
GTGAATGAAG AAGAAAATAA ACGTTTATCC GCTGTGCCAG CAGCGTAA

EF110-2 (SEQ ID NO:426)
MKKFSIRKIS AGFLFLILVT LIAGFSLSAN AEEYIVPAES HSRQKRSLLD
PEDRRQEVAD TTEAPFASIG RIISPASKPG YISLGTGFVV GTNTIVTNNH VAESFKNAKV
LNPNAKDDAW FYPGRDGSAT PFGKFKVIDV AFSPNADIAV VTVGKQNDRP DGPELGEILT
PFVLKKFESS DTHVTISGYP GEKNHTQWSH ENDLFTSNFT DLENPLLFYD IDTTGGQSGS
PIYNDQVEVV GVHSNGGIKQ TGNHGQRLNE VNYNFIVNRV NEEENKRLSA VPAA

EF110-3 (SEQ ID NO:427)
AG AGTATATCGT TCCTGCCGAA AGTCATTCAC GACAAAAAAG ATCGTTACTG
GACCCTGAGG ACAGAAGACA AGAAGTGGCA GATACAACCG AAGCGCCTTT TGCGTCAATC
GGAAGAATCA TTTCCCCTGC CAGTAAACCA GGCTATATTT CTTTAGGAAC AGGCTTTGTT
GTTGGAACCA ATACAATTGT CACCAATAAT CATGTGGCTG AAAGTTTTAA GAATGCCAAA
GTATTAAATC CGAATGCCAA AGATGATGCT TGGTTTTATC CAGGTCGAGA TGGCAGTGCG
ACACCATTTG GCAAATTCAA AGTGATTGAT GTAGCTTTTT CCCCGAATGC GGATATTGCG
GTAGTGACTG TCGGCAAACA AAACGATCGT CCAGATGGCC CAGAGTTGGG AGAAATTTTA
ACGCCATTTG TTTTGAAAAA GTTTGAATCT TCAGATACCC ATGTCACAAT ATCAGGCTAT
CCAGGTGAGA AAACCACAC ACAATGGTCT CATGAAAATG ATTTGTTTAC ATCTAACTTT
ACAGACTTAG AAAATCCATT ACTATTTTAT GATATCGATA CAACCGGCGG TCAATCTGGT
TCACCAATCT ATAATGATCA GGTTGAAGTA GTTGGTGTTC ATTCCAATGG CGGCATTAAG
CAAACAGGAA ATCATGGTCA AAGACTAAAT GAAGTGAATT ATAACTTTAT TGTTAATCGA
GTGAATGAAG AAGAAAATAA ACGTTTATCC GCTGTGCCAG CAGCGT

EF110-4 (SEQ ID NO:428)
EYIPAES HSRQKRSLLD
PEDRRQEVAD TTEAPFASIG RIISPASKPG YISLGTGFVV GTNTIVTNNH VAESFKNAKV
LNPNAKDDAW FYPGRDGSAT PFGKFKVIDV AFSPNADIAV VTVGKQNDRP DGPELGEILT
PFVLKKFESS DTHVTISGYP GEKNHTQWSH ENDLFTSNFT DLENPLLFYD IDTTGGQSGS
PIYNDQVEVV GVHSNGGIKQ TGNHGQRLNE VNYNFIVNRV NEEENKRLSA VPAA

TABLE 1-continued

Nucleotide and Amino Acid Seqeuences of E. faecalis Genes.

EF111-1 (SEQ ID NO:429)
TGATCAATAC ACTTCGATAC GGTCGCTTTT TTTCTAGAGA AAGTTGAATC TTTCAATAAT
AAAAAGGGAT ACACTCCATT TGGCATAGTC CTTGCTGATA ATAAATCAGT GTATAAAGCG
CTATCATTTT ATAGGAGGGG TTTTATGAAG GGTTTATCAA AAAGAAACG GGTGTCTACT
TGGTTAGCGT TAGGAATCAC CGTAGTCAGC TGTTTTGCGT TAAGCAGGGA AGTGCAAGCA
AGTGTTGAAA GAACAAAAGT TGATGAATTT GCAAATGTTT TAGATGTGAG TGCATCACCA
ACCGAACGGA CGAATGGCGT ATACGATACC AATTATTTTA ATAATTTTTC TGATTTAGGT
GCATCCCATG GCTACTATTT ACCTGAAAAA AGCAATAAAG AGCTACTGGG TGGTTTTGCG
GGGCCATTGA TTATTGCGGA AGAATATCCA GTAAACTTGG CGGCAAGTTT AAACAAATTA
ACGGTCAAAA ATAAAAAAAC GGGAGAAACC TATGATTTAA GCCAAAGCAA CCGCATGGAC
CTGTCTTATT ATCCTGGGCG CCTAGAGCAA ACCTATGAAT TAGACGATTT AACGATTCAT
TTAGCTTTAA TTTTTGTCAG CAATCGAACG GCGCTTATCC AAACGACACT TGAAAACACT
GGTGAAGAGC CCTTGTCACT TGGAGCAAGC TGGACAGGTG CGGTCTTTGA CAAAATTCAA
GAGGGAACGG AAACCTTAGA TATTGGCACT CGTTTAACTG CTAAAGACAA TGACATTCAA
GTGAATTTTG GTGAAGTCAG AGAAACGTGG AATTATTTTG CTACGAAAGA CACAAAAATAT
ACGATTCATC ATGCGGATAA AGTTTCAACA AAAATTGATA ATCGGAATTA TACAGCAACC
GCTGAACCAA TTGAATTGAA GCCTAAACAA ACGTACAACA CCTATACGAC AGAAAGCTAT
ACTTTTACAA AAGAAGAAGA GGCAAAGGAA CAACAACAAG CACCCGAATA TACCAAAAAT
GCGGCGCGCT ATTTCAAAGA GAACAAGCAA AGATGGCAAG GATATCTAGA TAAAACGTTT
GATCAAAAGA AAACAGCAGA ATTTCCTGAA TATCAAAATG CGCTAGTCAA ATCGATTGAA
ACGATTAATA CCAATTGGCG AAGTGCGGCA GGTGCCTTTA AGCATGACGG GATTGTTCCG
TCCATGTCTT ATAAATGGTT TATTGGTATG TGGGCTTGGG ATTCGTGGAA AGCGGATGTA
GCAACGGCTG ATTTTAATCC TGAGTTAGCT AAAAATAATA TGCGGGCCTT GTTTGATTAT
CAAATTCAAA AGATGATAC CGTACGTCCA CAAGATGCAG GAGCGATCAT TGATGCTGTC
TTTTACAATC AAGACAGTGC GCGTGGTGGT GAAGGTGGCA ACTGGAATGA ACGAAATTCT
AAACCACCAT TGGCTGCATG GGCAGTTTGG CATATTTATC AAGAAACCAA AGATAAGGAA
TTTTTAAAAG AAATGTATCC CAAGTTGTG GCTTATCATA ATTGGTGGTA TACCAACAGA
GACCACAATA AAAATGGGAT AGCAGAATAT GGAAGCATGG TCAGTGATGC TCACTGGCAA
AAAGACGACA AGGATCAAAT CATTAAAGAT AAAAATGGCC ACCTAAAGTG GATGATGATG
CTGTTATTGA AGCAGCCGCG TGGGAAAGTG GCATGGATAA CGCTACACGG TTTGACAAAG
AAGGTGTGGG CAAAGGCGAC GTTGGAGTTA AAGTTTTTGA AAACAAAAAT AAAGGAAAAG
TAG

EF111-2 (SEQ ID NO:430)
MKG LSKKKRVSTW
LALGITVVSC FALSREVQAS VERTKVDEFA NVLDVSASPT ERTNGVYDTN YFNNFSDLGA
WHGYYLPEKS NKELLGGFAG PLIIAEEYPV NLAASLNKLT VKNKKTGETY DLSQSNRMDL
SYYPGRLEQT YELDDLTIHL ALIFVSNRTA LIQTTLENTG EEPLSLGASW TGAVFDKIQE
GTETLDIGTR LTAKDNDIQV NFGEVRETWN YFATKDTKYT IHHADKVSTK IDNRNYTATA
EPIELKPKQT YNTYTTESYT FTKEEEAKEQ QQAPEYTKNA ARYFKENKQR WQGYLDKTFD
QKKTAEFPEY QNALVKSIET INTNWRSAAG AFKHDGIVPS MSYKWFIGMW AWDSWKADVA
TADFNPELAK NNMRALFDYQ IQKDDTVRPQ DAGAIIDAVF YNQDSARGGE GGNWNERNSK
PPLAAWAVVH IYQETKDKEF LKEMYPKLVA YHNWWYTNRD HNKNGIAEYG SMVSDAHWQK
DDKDQIIKDK NGHLKWMMML LLKQPRGKVA WITLHGLTKK VWAKATLELK FLKTKIKEK

EF111-3 (SEQ ID NO:431)
TGATGAATTT GCAAATGTTT TAGATGTGAG TGCATCACCA
ACCGAACGGA CGAATGGCGT ATACGATACC AATTATTTTA ATAATTTTTC TGATTTAGGT
GCATGGCATG GCTACTATTT ACCTGAAAAA AGCAATAAAG AGCTACTGGG TGGTTTTGCG
GGGCCATTGA TTATTGCGGA AGAATATCCA GTAAACTTGG CGGCAAGTTT AAACAAATTA
ACGGTCAAAA ATAAAAAAAC GGGAGAAACC TATGATTTAA GCCAAAGCAA CCGCATGGAC
CTGTCTTATT ATCCTGGGCG CCTAGAGCAA ACCTATGAAT TAGACGATTT AACGATTCAT
TTAGCTTTAA TTTTTGTCAG CAATCGAACG GCGCTTATCC AAACGACACT TGAAAACACT
GGTGAAGAGC CCTTGTCACT TGGAGCAAGC TGGACAGGTG CGGTCTTTGA CAAAATTCAA
GAGGGAACGG AAACCTTAGA TATTGGCACT CGTTTAACTG CTAAAGACAA TGACATTCAA
GTGAATTTTG GTGAAGTCAG AGAAACGTGG AATTATTTTG CTACGAAAGA CACAAAAATAT
ACGATTCATC ATGCGGATAA AGTTTCAACA AAAATTGATA ATCGGAATTA TACAGCAACC
GCTGAACCAA TTGAATTGAA GCCTAAACAA ACGTACAACA CCTATACGAC AGAAAGCTAT
ACTTTTACAA AAGAAGAAGA GGCAAAGGAA CAACAACAAG CACCCGAATA TACCAAAAAT
GCGGCGCGCT ATTTCAAAGA GAACAAGCAA AGATGGCAAG GATATCTAGA TAAAACGTTT
GATCAAAAGA AAACAGCAGA ATTTCCTGAA TATCAAAATG CGCTAGTCAA ATCGATTGAA
ACGATTAATA CCAATTGGCG AAGTGCGGCA GGTGCCTTTA AGCATGACGG GATTGTTCCG
TCCATGTCTT ATAAATGGTT TATTGGTATG TGGGCTTGGG ATTCGTGGAA AGCGGATGTA
GCAACGGCTG ATTTTAATCC TGAGTTAGCT AAAAATAATA TGCGGGCCTT GTTTGATTAT
CAAATTCAAA AGATGATAC CGTACGTCCA CAAGATGCAG GAGCGATCAT TGATGCTGTC
TTTTACAATC AAGACAGTGC GCGTGGTGGT GAAGGTGGCA ACTGGAATGA ACGAAATTCT
AAACCACCAT TGGCTGCATG GGCAGTTTGG CATATTTATC AAGAAACCAA AGATAAGGAA
TTTTTAAAAG AAATGTATCC CAAGTTGTG GCTTATCATA ATTGGTGGTA TACCAACAGA
GACCACAATA AAAATGGGAT AGCAGAATAT GGAAGCATGG TCAGTGATGC TCACTGGCAA
AAAGACGACA AGGATCAAAT CATTAAAGAT AAAAATGGCC ACCTAAAGTG GATGATGATG
CTGTTATTGA AGCAGCCGCG TGGGAAAGTG GCATGGATAA CGCTACACGG TTTGACAAAG
AAGGTGTGGG CAAAGGCGAC GTTGGAGTTA AAGTT

EF111-4 (SEQ ID NO:432)
DEFA NVLDVSASPT ERTNGVYDTN YFNNFSDLGA
WHGYYLPEKS NKELLGGFAG PLIIAEEYPV NLAASLNKLT VKNKKTGETY DLSQSNRMDL

TABLE 1-continued

Nucleotide and Amino Acid Seqeuences of E. faecalis Genes.

SYYPGRLEQT YELDDLTIHL ALIFVSNRTA LIQTTLENTG EEPLSLGASW TGAVFDKIQE
GTETLDIGTR LTAKDNDIQV NFGEVRETWN YFATKDTKYT IHHADKVSTK IDNRNYTATA
EPIELKPKQT YNTYTTESYT FTKEEEAKEQ QQAPEYTKNA ARYFKENKQR WQGYLDKTFD
QKKTAEFPEY QNALVKSIET INTNWRSAAG AFKHDGIVPS MSYKWFIGMW AWDSWKADVA
TADFNPELAK NNMRALFDYQ IQKDDTVRPQ DAGAIIDAVF YNQDSARGGE GGNWNERNSK
PPLAAWAVWH IYQETKDKEF LKEMYPKLVA YHNWWYTNRD HNKNGIAEYG SMVSDAHWQK
DDKDQIIKDK NGHLKWMMML LLKQPRGKVA WITLHGLTKK VWAKATLELK

EF117-1 (SEQ ID NO:433)
TAATTCGATG GAGAAGGTGG TTTAGTGAAA AGATTTTCAT TTTTTTTACT AATTTTACTT
GCTTTAACAG GTTGTAAATC CGGTGAAAAA GAATTTGATG AAGAATCTCT TCAAAATCTA
AAGGAAACGN CACAGTCTTA NTCAGAAACA GAATTACAAA ATGGTGACGT TCGTTTAAAT
GAATATATTT CTTTGAAAGG GGAGATTGTT GAGAGTGACA GAGAGTGACA TTTAATAAAA
AAAGGTGATC GTTTTATTTT GAAAAGTGGT TCTAGTAAAT ATCAAGTTTN TAATGAGCAA
AAGAAAAAAT TGAAGATTGG TGACGAAGTG ACAGTTTACG GAGAATATTA CGGCTTTTTG
AAAGGGACAT TAATTGAAAG TGAGGAGAAT CATGATTCAG CCACGAATTA G

EF117-2 (SEQ ID NO:434)
VKR FSFFLLILLA LTGCKSGEKE FDEESLQNLK ETXQSXSETE LQNGDVRLNE
YISLKGEIVE SDSRSSLIKK GDRFILKSGS SKYQVXNEQK KKLKIGDEVT VYGEYYGFLK
GTLIESEENH DSATN

EF117-3 (SEQ ID NO:435)
TG AAGAATCTCT TCAAAATCTA
AAGGAAACGN CACAGTCTTA NTCAGAAACA GAATTACAAA ATGGTGACGT TCGTTTAAAT
GAATATATTT CTTTGAAAGG GGAGATTGTT GAGAGTGACA GTCGTTCCAG TTTAATAAAA
AAAGGTGATC GTTTTATTTT GAAAAGTGGT TCTAGTAAAT ATCAAGTTTN TAATGAGCAA
AAGAAAAAAT TGAAGATTGG TGACGAAGTG ACAGTTTACG GAGAATATTA CGGCTTTTTG
AAAGGGACAT TAATTGAAAG TGAGGAGAAT CATGATTCAG CCACGAA

EF117-4 (SEQ ID NO:436)
EESLQNLK ETXQSXSETE LQNGDVRLNE YISLKGEIVE SDSRSSLIKK GDRFILKSGS
SKYQVXNEQK KKLKIGDEVT VYGEYYGFLK GTLIESEENH DSATN

EF118-1 (SEQ ID NO:437)
TGAGGGGGAA AAAGTGTGTT AAAAAGAAAA GTGGGGATTG TCGCAGGCGT TTTCTGTTCA
GCTTTGTTAC TGACAGGTTG TGGCAAAAGT GCGAAAGATG AGTTCATTCA AGGAATCGGC
AATCANAACG CACAAGAATC TGGGGTTTGN GATTTCTCTA TGTCAATTAG TGACATGAAA
TTTTCACAAG AAGATGGTGC ACAAACGAAT CCTATGATTG GGATGCTCAT CACGCAAATC
AAAGACGCAT CGCTTTCTGG GGAAGATTCA AGTAGATGCC AAAAAAGAAA AGCATTCAA
CTTAGAGATG AAATTAAAAG CGATGGGAAT GGATGTACCG ATTTCATTGG TTGGATCGTT
AGATAA

EF118-2 (SEQ ID NO:438)
VLKRKV GIVAGVFCSA LLLTGCGKSA KDEFIQGIGN XNAQESGVXD FSMSISDMKF
SQEDGAQTNP MIGMLITQIK DASLSGEDSS RCQKRKSIQL RDEIKSDGNG CTDFIGWIVR

EF118-3 (SEQ ID NO:439)
GAAAGATG AGTTCATTCA AGGAATCGGC
AATCANAACG CACAAGAATC TGGGGTTTGN GATTTCTCTA TGTCAATTAG TGACATGAAA
TTTTCACAAG AAGATGGTGC ACAAACGAAT CCTATGATTG GGATGCTCAT CACGCAAATC
AAAGACGCAT CGCTTTCTGG GGAAGATTCA AGTAGATGCC AAAAAAGAAA AGCATTCAA
CTTAGAGATG AAATTAAAAG CGATGGGAAT GGATGTACCG ATTTCATTGG TTGGATCGTT
AGAT

EF118-4 (SEQ ID NO:440)
KDEFIQGIGN XNAQESGVXD FSMSISDMKF SQEDGAQTNP MIGMLITQIK DASLSGEDSS
RCQKRKSIQL RDEIKSDGNG CTDFIGWIVR

EF119-1 (SEQ ID NO:441)
TAAAGAATAC CGAGTAAAAT TTTCGGAAGG CTTTTTTTCA AAAATTGTAT ATGCAAAAGA
AGTGCAACGG AAAGGAGCTC GGAAATCGTG AATAAGCTAC CTTTACTTAT TTTATTGTTA
GGCGGAGTGT TGCTTGTTAG TGGCTGTCAA AGCCATAAGG AAGAAAACAA GTCTAGTAAA
GTATCGACAG AAGAAACGAC AGTGATTGAA ACAGTAGCAA GGGAACAATC GAAGGAATCG
TTTACGAGTG AAGCAACTAA AAAACAGACA GAAACAACGA AATTAGAAGA ACCAGATCAT
GTAAAACTTC TAGAAGCTTA TGGAAATGCG TATGCGAACT TTACAAGTAT TAATGATCGC
AATGAAAAGC TAAAGCCCCT CATGACTGAA AAATGTATCA AAAAAAATGG AATTGATGTT
AAAACTGGAG TAGCGTTAGT TTCCGTAGGA AAGGTTACAA CGATTTATAA AAATGATCAA
CATGAATATG CTTTACTTTT GGATTGTGAA CAAAATGGAA CGCAGACACG AGTGTTACTT
TTGGCTAAGG TGAAGAACAA TAAAATTTCT GAAATGACCT ATAATTCAGT TAAGCAAGAG
TATTAG

EF119-2 (SEQ ID NO:442)
VN KLPLLILLLG GVLLVSGCQS HKEENKSSKV STEETTVIET VAREQSKESF TSEATKKQTE
TTKLEEPDHV KLLEAYGNAY ANFTSINDRN EKLKPLMTEK CIKKNGIDVK TGVALVSVGK
VTTIYKNDQH EYALLLDCEQ NGTQTRVLLL AKVKNNKISE MTYNSVKQEY

TABLE 1-continued

Nucleotide and Amino Acid Seqeuences of E. faecalis Genes.

EF119-3 (SEQ ID NO:443)
AGAAAACAA GTCTAGTAAA
GTATCGACAG AAGAAACGAC AGTGATTGAA ACAGTAGCAA GGGAACAATC GAAGGAATCG
TTTACGAGTG AAGCAACTAA AAAACAGACA GAAACAACGA AATTAGAAGA ACCAGATCAT
GTAAAACTTC TAGAAGCTTA TGGAAATGCG TATGCGAACT TTACAAGTAT TAATGATCGC
AATGAAAAGC TAAACGGGGT CATGACTGAA AAATGTATCA AAAAAAATGG AATTGATGTT
AAAACTGGAG TAGCGTTAGT TTCCGTAGGA AAGGTTACAA CGATTTATAA AAATGATCAA
CATGAATATG CTTTACTTTT GGATTGTGAA CAAAATGGAA CGCAGACACG AGTGTTACTT
TTGGCTAAGG TGAAGAACAA TAAAATTTCT CAAATGACCT ATAATTCAGT TAAGCAAGAG
TAT

EF119-4 (SEQ ID NO:444)
ENKSSKV STEETTVIET VAREQSKESF TSEATKKQTE TTKLEEPDHV KLLEAYGNAY
ANFTSINDRN
EKLKPLMTEK CIKKNGIDVK TGVALVSVGK VTTIYKNDQH EYALLLDCEQ NGTQTRVLLL
AKVKNNKISE MTYNSVKQEY

EF120-1 (SEQ ID NO:445)
TGAATAGGCG TGAAAAAGGG AATGTTAGCG TTTTTTGTCG TGCTAGCGGT TTTATCATTA
ACTGCTTGTC GGGAACCAAA AGNAAAGAAA GTAACCGCTT CAACGGAGGC ATCCTCTAAA
GTTGAAGAGA CGAATGAAAA AACGAGTGAA ACAATTGATA AGACAAACGA ACAAGCGAGC
AGCAGTGTCG AGTCTAACGA ATCAGTGAAA AATGAAGAGC CGACAGCTGA TGGAAACAAT
AGTCAGCTAA CTGTAGCTGA TTTAGATACT ACAGCGATTA ATGCTGGCGA TTTTACTACT
TTAGTTGGAA TATGGAAAAA TGGTAAAGGA GAGAGTTTGA TCATTCATCC TGATGGTAGT
ACAAATACCG GAGGAATGAT TACGAAGGAT TCACCTACTG ATGAGTCGCG ACCAATTACA
AGCTTAAGTA TTAGGTGGGG GCCTACTGGT GCTGCGCTAT TATTATATAA AATTGGTGTT

EF120-2 (SEQ ID NO:446)
VKKGMLAF FVVLAVLSLT ACREPKXKKV TASTEASSKV EETNEKTSET IDKTNEQASS
SVESNESVKN EEPTADGNNS QLTVADLDTT AINAGDFTTL VGIWKNGKGE SLIIHPDGST
NTGGMITKDS PTDESRPITS LSIRWGPTGA ALLLYKIGV

EF120-3 (SEQ ID NO:447)
AAGAAA GTAACCGCTT CAACGGAGGC ATCCTCTAAA
GTTGAAGAGA CGAATGAAAA AACGAGTGAA ACAATTGATA AGACAAACGA ACAAGCGAGC
AGCAGTGTCG AGTCTAACGA ATCAGTGAAA AATGAAGAGC CGACAGCTGA TGGAAACAAT
AGTCAGCTAA CTGTAGCTGA TTTAGATACT ACAGCGATTA ATGCTGGCGA TTTTACTACT
TTAGTTGGAA TATGGAAAAA TGGTAAAGGA GAGAGTTTGA TCATTCATCC TGATGGTAGT
ACAAATACCG GAGGAATGAT TACGAAGGAT TCACCTACTG ATGAGTCGCG ACCAATTACA
AGCTTAAGTA TTAGGTGGGG GCCTACTGGT GCTGCGCTAT TATTATATAA AATTGGTGTT

EF120-4 (SEQ ID NO:448)
KKV TASTEASSKV EETNEKTSET IDKTNEQASS
SVESNESVKN EEPTADGNNS QLTVADLDTT AINAGDFTTL VGIWKNGKGE SLIIHPDGST
NTGGMITKDS PTDESRPITS LSIRWGPTGA ALLLYKIGV

EF121-1 (SEQ ID NO:449)
TGAAACACAA GGAGGAAATT TGTGAAAAAG TTGAGCTTTA AAAAAGTGAA GTGGGGCATG
CATTTTTTAA TGGCTGTTGC GTTGATAGCG CCAAGTGTTA CTAGTACGGC ATATGCAGTA
GAAACAACGA GTCAACAAAG TTCAGAAGCA GTAACAAGTA CCACCGATTC AAGTAGAAGA
CAAGAACCAG TCATTACACA GGAAACAACA GACATCAAAC AAGAAGCACC AAATCAGGCT
ACGAGTGACA GTGTCAAGCA GTCACAAGAA ACCACAGCAC AACAGAGAC GACGAATTTA
GAAACGTCAA TCGCTGAAAA AGAAGAAACG AGCACGCCGC AAAAAATAAC AATTTTAGGT
ACGTCAGATG TTCATGGTCA ATTATGGAAT TGGTCTTATG AAGATGATAA AGAACTACCA
GTTGGTTTGT CCCAAGTAAG TACAGTCGTT AACCAAGTCC GGGCACAAAA CCCAGCAGGC
ACCGTTTTAA TTGATAATGG CGACAATATT CAAGGCACTA TTTTAACAGA TGACTTGTAT
AATAAAGCGC CTTTAGTGAA TGAAAAGACC CATCCAATGA TCACCGCCAT GAATGTGATG
AAGTATGATG CAATGGTTTT GGGAAATCAT GAGTTTAATT TTGGTTTACC GTTAATCAAA
AAAATTCAAC AAGAAGCCAC TTTTCCAATC TTGTCTGCGA ATACCTACAA TAAGGAAGAT
GGTCTTCGTT TTGTTGAAGG GACTACCACG AAGGAACTTG ATTTTAATCA AGATGGGCAG
CCAGATTTAA AAGTTGGGAT TATCGGCTTA ACAATTCCGC ACATTCCTTT GTGGGATGGC
CCTCGTGTTA CTTCGCTTAA TTTTTTACCT TTGAAAGAAG AAGCAGAAAA AGCAGTTCAT
GAGTTGAAAG CTAACGATCA GGCTGACATT ATTGTTGCCT CGATTCATGC GGGACAACAA
AATAGTGATC CGGCTGCCAG TGCCGACCAA GTAATTGAAA ATGTCGCGGG GATTGATGCG
TATATTCTGG TCATGACCA CCTTTCTTTT ACCAAGCAAG GAGCAGCGCC GAATGGAAAA
ACTGTACCGG TAGGGGGACC GAAAGATACG GGGACAGAG TTGTCAAAAT TGATCTTTCA
GTTGCTAAAA ATGCCGATAA GTGGGAAGTG CAAGAAGGTA CAGCAACGAT TGTACCAACA
ACGAATGTTC CAGCAGATGA AGCAGTTAAG GCAGCGACAA AAGAATACCA TGAAAAAACG
CGAGCGTTTA TTCAGGAGGA GATCGGCACA GCAACAGCTG ATTTTTTACC AAAACAAGAA
ATTAAAGGAA TTCCCGAAGC ACAATTACAA CCAACAGCGA TGATTTCTTT AATTAATAAC
GTTCAAAAAG AAGTAACGGG CGCACAATTA AGTGCGGCAG CGCTGTTTAA ATACGACAGT
AAATTACCTG CGGGGAAGAT TTCCTATGCC ACGATTTTTG ATATCTACAA ATACCCGAAT
ACCTTAGTGA GTGTTCCCAT TAACGGTGAA AACTTACTGA AGTATTTAGA AAAACAAGGG
GCGTACTATA ACCAAACACA GCCAGATGAT TTGACCATTA GTTTTAATCC AAACATTCGT
GTATATAACT ATGACATGAT TTCTGGAGTG GACTACAAGA TTGACATTTC AAAACCAGTG
GGTGAACGAA TTGTAGATGC GAAAATTGAC GGCCAACCGC TGGATCCTGC CAAAGAATAT

TABLE 1-continued

Nucleotide and Amino Acid Seqeuences of E. faecalis Genes.

ACGATTGCTA TGAATAATTA TCGTTACGGC GGTTTAGCTA GCCAAGGGAT TCAAGTAGGG
GAACCTATTA AAAATTCTGA TCCAGAAACC TTACGAGGAA TGATTGTTGA TTATATTAAG
AAAAAAGGAA CTCTTGATCC AGAACAAGAA ATCAACGAA ATTGGTCAAT TATTGGGACA
AATTTTGATG AAAAATGGCG TGCCAAAGCA ATCGAATTAG TGAATGACGG CACTCTTCAA
ATTCCGACTT CTCCTGATGG ACGTACACCA AACGCCGCCG CTATTACGAA ACAAGATGTC
CGTAATGCGG GCTTTGATTT AGATAATGCA TATACCATTA TGCACACAAA TGACGTTCAT
GGCCGACTAG AAGCAGGGAA AGGCGAATTA GGTATGGCGC GTCTAAAAAC CTTTAAAGAC
CAAGAAAACC CAACCTTGAT GGTGGATGCA GGGGATGTTT TCCAAGGATT ACCAATCTCC
AATTTCTCCA AAGGCGCGGA TATGGCCAAA GCAATGAATG AAGTTGGTTA TGATGCCATG
GCGGTGGGAA ATCACGAGTT TGATTTTGGT TTAGAGATTG CACTAGGTTA TAAAGACCAA
CTGAATTTTC CGATTTTATC TAGTAATACG TATTACAAAG ATGGCAGTGG ACGGGTTTTT
GATCCGTATA CAATCGTAGA AAAATCCGGG AAAAAGTTTG CCATTGTAGG TGTGACGACC
CCAGAAACAG CAACGAAAAC ACACCCGAAA AACGTAGAGA AGGTGACATT TAAAGACCCG
ATTCCAGAAG TAGAAGCAGT GATTAAGGAA ATTAAAGAGA AGTACGCGGA TATNCAAGCT
TTCGTGGTTA CTGGGCATTT AGGCGTAGAT GAAACGACGC CGCATATCTG GCGTGGTGAT
ACGCTAGCAG AAACCCTTAG TCAAACATAT CCTGAGTTAG ATATCACTGT GATTGATGGA
CATTCGCATA CAGCCGTCGA AAGTGGCAAA CGTTATGGCA AAGTGATCTA TGCTCAAACA
GGTAATTATT TAAATAATGT TGGGATCGTC ACAGCACCAG AGAGTGAACC AACTAAGAAA
ACAACAAAAT TGATTTCAGC AGCAGAGCTG CTAGAATTGC CAGAAAACCC GGCAGTTAAA
GCCATCGTTG ATGAAGCACG TACGAATTTT AACGCTGAAA ATGAAAAAGT AATTGTCGAT
TATATTCCAT TCACATTGGA TGGACAACGA GAAAATGTGC GCACACGAGA GACCAACTTA
GGGAATTTGA TTGGTGATGC GATTATGTCA TATGGCCAAG ACGCGTTTAG CCAACCTGCT
GATTTTGCAG TAACTAATGG TGGCGGCATT CGCGCTGATA TTAAACAAGG GCCAATTAAA
GTTGGGGATG TCATTGCTGT GTTACCTTTT GGCAATAGCA TTGCGCAAAT TCAAGTAACC
GGCGCCCAAG TTAAAGAAAT GTTTGAAATG TCTGTTCGTT CGATTCCACA AAAAGATGAG
AATGGCACAA TTTTACTAGA TGATGCTGGC CAACCAAAAC TTGGCGCAAA TGGTGGTGCA
CTACATGTTT CAAGCTCCAT TCGTATCCAC TATGATTCCA CAAAACCAGG TACTCGCTTG
GCTAGTGACG AAGGCAATGA AACAGGACAA ACGATTGTCG GTAGTCGCGT ATTAGGAATA
GAAATTAAAA ATCGGCAAAC ACAAAAGTTT GAACCATTGG ATGAGAAGAA ACAATACCGG
ATGGCTACCA ATGATTTCTT AGCTGCTGGT GGTGATGGTT ACGATATGCT AGGTGGTGAA
CGAGAAGAAG GGATTTCACT AGATTCTGTC TTAATTGAAT ACTTGAAAAG TGCAACCAGC
TTGCGGTTGT ATCGTGCAGC AACGACGATT GATTTAGCAC AATATAAAGA ACCATTCCCA
GGCGAACGAA TTGTTTCTAT TTCGGAAGAA GCTTACAAAG AGTTAATCGG TGGAGGAGAG
ACGCCAAAAC CAGATCCAAA ACCAGACCCG AAACCAACCA CGAAAACACC AGTAGCAACC
AATAAACAAA ACCAAGCGGG AGCAAGACAG AGCAATCCAT CCGTAACAGA AAAGAAAAAG
TATGGCGGCT TTTTACCTAA AACGGGTACA GAAACAGAAA CGCTTGCATT ATATGGTTTA
CTGTTCGTTG GACTTTCTTC TTCTGGCTGG TATATTTATA AACGACGTAA CAAAGCTAGT
TAG

EF121-2 (SEQ ID NO:450)
VKKL SFKKVKWGMH FLMAVALIAP SVTSTAYAVE TTSQQSSEAV TSTTDSSRKQ
EPVITQETTD IKQEAPNQAT SDSVKQSQET TAPTETTNLE TSIAEKEETS TPQKITILGT
SDVHGQLWNW SYEDDKELPV GLSQVSTVVN QVRAQNPAGT VLIDNGDNIQ GTILTDDLYN
KAPLVNEKTH PMITAMNVMK YDAMVLGNHE FNFGLPLIKK IQQEATFPIL SANTYNKEDG
LRFVEGTTTK ELDFNQDGQP DLKVGIIGLT IPHIPLWDGP RVTSLNFLPL KEEAEKAVTE
LKANDQADII VASIHAGQQN SDPAASADQV IENVAGIDAY ILGHDHLSFT KQGAAPNGKT
VPVGGPKDTG TEVVKIDLSV AKNADKWEVQ EGTATIVPTT NVPADEAVKA ATKEYHEKTR
AFIQEEIGTA TADFLPKQEI KGIPEAQLQP TAMISLINNV QKEVTGAQLS AAALFKYDSK
LPAGKISYAT IFDIYKYPNT LVSVPINGEN LLKYLEKQGA YYNQTPPDDL TISFNPNIRV
YNYDMISGVD YKIDISKPVG ERIVDAKIDG QPLDPAKEYT IAMNNYRYGG LASAGIQVGE
PIKNSDPETL RGMIVDYIKK KGTLDPEQEI ERNWSIIGTN FDEKWRAKAI ELVNDGTLQI
PTSPDGRTPN AAAITKQDVR NAGFDLDNAY TIMHTNDVHG RLEAGKGELG MARLKTFKDQ
ENPTLMVDAG DVFQGLPISN FSKGADMAKA MNEVGYDAMA VGNHEFDFGL EIALGYKDQL
NFPILSSNTY YKDGSGRVFD PYTIVEKSGK KFAIGVTTP ETATKTHPKN VEKVTFKDPI
PEVEAVIKEI KEKYADXQAF VVTGHLGVDE TTPHIWRGDT LAETLSQTYP ELDITVIDGH
SHTAVESGKR YGKVIYAQTG NYLNNVGIVT APESEPTKKT TKLISAAELL ELPENPAVKA
IVDEARTNFN AENEKVIVDY IPFTLDGQRE NVRTRETNLG NLIGDAIMSY GQDAFSQPAD
FAVTNGGGIR ADIKQGPIKV GDVIAVLPFG NSIAQIQVTG AQVKEMFEMS VRSIPQKDEN
GTILLDDAGQ PKLGANGGFL HVSSSIRIHY DSTKPGTRLA SDEGNETGQT IVGSRVLGIE
IKNRQTQKFE PLDEKKQYRM ATNDFLAAGG DGYDMLGGER EEGISLDSVL IEYLKSATSL
RLYRAATTID LAQYKEPFPG ERIVSISEEA YKELIGGGET PKPDPKPDPK PTPETPVATN
KQNQAGARQS NPSVTEKKKY GGFLPKTGTE TETLALYGLL FVGLSSSGWY IYKRRNKAS

EF121-3 (SEQ ID NO:451)
ACAAAG TTCAGAAGCA GTAACAAGTA CCACCGATTC AAGTAGAAAA
CAAGAACCAG TCATTACACA GGAAACAACA GACATCAAAC AAGAAGCACC AAATCAGGCT
ACGAGTGACA GTGTCAAGCA GTCACAAGAA ACCACAGCAC CAACAGAGAC GACGAATTTA
GAAACGTCAA TCGCTGAAAA AGAAGAAACG AGCACGCCGC AAAAAATAAC AATTTTAGGT
ACGTCAGATG TTCATGGTCA ATTATGGAAT TGGTCTTATG AAGATGATAA AGAACTACCA
GTTGGTTTGT CCCAAGTAAG TACAGTCGTT AACCAAGTCC GGGCACAAAA CCCAGCAGGC
ACCGTTTTAA TTGATAATGG CGACAATATT CAAGGCACTA TTTTAACAGA TGACTTGTAT
AATAAAGCGC CTTTAGTGAA TGAAAAGACC CATCCAATGA TCACCGCCAT GAATGTGATG
AAGTATGATG CAATGGTTTT GGGAAATCAT GAGTTTAATT TTGGTTTACC GTTAATCAAA
AAAATTCAAC AAGAAGCCAC TTTTCCAATC TTGTCTGCGA ATACCTACAA TAAGGAAGAT
GGTCTTCGTT TTGTTGAAGG GACTACCACG AAGGAACTTG ATTTTAATCA AGATGGGCAG
CCAGATTTAA AAGTTGGGAT TATCGGCTTA ACAATTCCGC ACATTCCTTT GTGGGATGGC
CCTCGTGTTA CTTCGCTTAA TTTTTTACCT TTGAAAGAAG AAGCAGAAAA AGCAGTTACT

TABLE 1-continued

Nucleotide and Amino Acid Seqeuences of E. faecalis Genes.

```
GAGTTGAAAG CTAACGATCA GGCTGACATT ATTGTTGCCT CGATTCATGC GGGACAACAA
AATAGTGATC CGGCTGCCAG TGCCGACCAA GTAATTGAAA ATGTCGCGGG GATTGATGCG
TATATTCTGG GTCATGACCA CCTTTCTTTT ACCAAGCAAG GAGCAGCGCC GAATGGAAAA
ACTGTACCGG TAGGGGGACC GAAAGATACG GGGACAGAAG TTGTCAAAAT TGATCTTTCA
GTTGCTAAAA ATGCCGATAA GTGGGAAGTG CAAGAAGGTA CAGCAACGAT TGTACCAACA
ACGAATGTTC CAGCAGCTGA AGCAGTTAAG GCAGCGACAA AAGAATACCA TGAAAAAACG
CGAGCGTTTA TTCAGGAGGA GATCGGCACA GCAACAGCTG ATTTTTTACC AAAACAAGAA
ATTAAAGGAA TTCCCGAAGC ACAATTACAA CCAACAGCGA TGATTTCTTT AATTAATAAC
GTTCAAAAAG AAGTAACGGG CGCACAATTA AGTGCGGCAG CGCTGTTTAA ATACGACAGT
AAATTACCTG CGGGGAAGAT TTCCTATGCC ACGATTTTTG ATATCTACAA ATACCCGAAT
ACCTTAGTGA GTGTTCCCAT TAACGGTGAA AACTTACTGA AGTATTTAGA AAAACAAGGG
GCGTACTATA ACCAAACACA GCCAGATGAT TTGACCATTA GTTTTAATCC AAACATTCGT
GTATATAACT ATGACATGAT TTCTGGAGTG GACTACAAGA TTGACATTTC AAAACCAGTG
GGTGAACGAA TTGTAGATGC GAAAATTGAC GGCCAACCGC TGGATCCTGC AAAGAATAT
ACGATTGCTA TGAATAATTA TCGTTACGGC GGTTTAGCTA GCCAAGGGAT TCAAGTAGGG
GAACCTATTA AAAATTCTGA TCCAGAAACC TTACAGGAGA TGATTGTTGA TTATATTAAG
AAAAAAGGAA CTCTTGATCC AGAACAAGAA ATCGAACGAA ATTGGTCAAT TATTGGGACA
AATTTTTGATG AAAAATGGCG TGCCAAAGCA ATCGAATTAG TGAATGACGG CACTCTTCAA
ATTCCGACTT CTCCTGATGG ACGTACACCA AACGCCG
```

EF121-4 (SEQ ID NO:452)
QSSEAV TSTTDSSRKQ
EPVITQETTD IKQEAPNQAT SDSVKQSQET TAPTETTNLE TSIAEKEETS TPQKITILGT
SDVHGQLWNW SYEDDKELPV GLSQVSTVVN QVRAQNPAGT VLIDNGDNIQ GTILTDDLYN
KAPLVNEKTH PMITAMNVMK YDAMVLGNHE FNFGLPLIKK IQQEATFPIL SANTYNKEDG
LRFVEGTTTK ELDFNQDGQP DLKVGIIGLT IPHIPLWDGP RVTSLNFLPL KEEAEKAVTE
LKANDQADII VASIHAGQQN SDPAASADQV IENVAGIDAY ILGHDHLSFT KQGAAPNGKT
VPVGGPKDTG TEVVKIDLSV AKNADKWEVQ EGTATIVPTT NVPADEAVKA ATKEYHEKTR
AFIQEEIGTA TADFLPKQEI KGIPEAQLQP TAMISLINNV QKEVTGAQLS AAALFKYDSK
LPAGKISYAT IFDIYKYPNT LVSVPINGEN LLKYLEKQGA YYNQTQPDDL TISFNPNIRV
YNYDMISGVD YKIDISKPVG ERIVDAKIDG QPLDPAKEYT IAMNNYRYGG LASQGIQVGE
PIKNSDPETL RGMIVDYIKK KGTLDPEQEI ERNWSIIGTN FDEKWRAKAI ELVNDGTLQI
PTSPDGRTPN A

EF122-1 (SEQ ID NO:453)
```
TGAAACACAA GGAGGAAATT TGTGAAAAAG TTGAGCTTTA AAAAAGTGAA GTGGGGCATG
CATTTTTTAA TGGCTGTTGC GTTGATAGCG CCAAGTGTTA CTAGTACGGC ATATGCAGTA
GAAACAACGA GTCAACAAAG TTCAGAAGCA GTAACAAGTA CCACCGATTC AAGTAGAAAA
CAAGAACCAG TCATTACACA GGAAACAACA GACATCAAAC AAGAAGCACC AAATCAGGCT
ACGAGTGACA GTGTCAAGCA GTCACAAGAA ACCACAGCAC AACAGAGAC GACGAATTTA
GAAACGTCAA TCGCTGAAAA AGAAGAAACG AGCACGCCGC AAAAAATAAC AATTTTAGGT
ACGTCAGATG TTCATGGTCA ATTATGGAAT TGGTCTTATG AAGATGATAA AGAACTACCA
GTTGGTTTGT CCCAAGTAAG TACAGTCGTT AACCAAGTCC GGGCACAAAA CCCAGCAGGC
ACCGTTTTAA TTGATAATGG CGACAATATT CAAGGCACTA TTTTAACAGA TGACTTGTAT
AATAAAGCGC CTTTAGTGAA TGAAAAGACC CATCCAATGA TCACCGCCAT GAATGTGATG
AAGTATGATG CAATGGTTTT GGGAAATCAT GAGTTTAATT TTGGTTTACC GTTAATCAAA
AAAATTCAAC AAGAAGCCAC TTTTCCAATC TTGTCTGCGA ATACCTACAA TAAGGAAGAT
GGTCTTCGTT TTGTTGAAGG GACTACCACG AAGGAACTTG ATTTTAATCA AGATGGGCAG
CCAGATTTAA AAGTTGGGAT TATCGGCTTA ACAATTCCGC ACATTCCTTT GTGGGATGGC
CCTCGTGTTA CTTCGCTTAA TTTTTTACCT TTGAAAGAAG AAGCAGAAAA AGCAGTTACT
GAGTTGAAAG CTAACGATCA GGCTGACATT ATTGTTGCCT CGATTCATGC GGGACAACAA
AATAGTGATC CGGCTGCCAG TGCCGACCAA GTAATTGAAA ATGTCGCGGG GATTGATGCG
TATATTCTGG GTCATGACCA CCTTTCTTTT ACCAAGCAAG GAGCAGCGCC GAATGGAAAA
ACTGTACCGG TAGGGGGACC GAAAGATACG GGGACAGAAG TTGTCAAAAT TGATCTTTCA
GTTGCTAAAA ATGCCGATAA GTGGGAAGTG CAAGAAGGTA CAGCAACGAT TGTACCAACA
ACGAATGTTC CAGCAGATGA AGCAGTTAAG GCAGCGACAA AAGAATACCA TGAAAAAACG
CGAGCGTTTA TTCAGGAGGA GATCGGCACA GCAACAGCTG ATTTTTTACC AAAACAAGAA
ATTAAAGGAA TTCCCGAAGC ACAATTACAA CCAACAGCGA TGATTTCTTT AATTAATAAC
GTTCAAAAAG AAGTAACGGG CGCACAATTA AGTGCGGCAG CGCTGTTTAA ATACGACAGT
AAATTACCTG CGGGGAAGAT TTCCTATGCC ACGATTTTTG ATATCTACAA ATACCCGAAT
ACCTTAGTGA GTGTTCCCAT TAACGGTGAA AACTTACTGA AGTATTTAGA AAAACAAGGG
GCGTACTATA ACCAAACACA GCCAGATGAT TTGACCATTA GTTTTAATCC AAACATTCGT
GTATATAACT ATGACATGAT TTCTGGAGTG GACTACAAGA TTGACATTTC AAAACCAGTG
GGTGAACGAA TTGTAGATGC GAAAATTGAC GGCCAACCGC TGGATCCTGC AAAGAATAT
ACGATTGCTA TGAATAATTA TCGTTACGGC GGTTTAGCTA GCCAAGGGAT TCAAGTAGGG
GAACCTATTA AAAATTCTGA TCCAGAAACC TTACAGGAGA TGATTGTTGA TTATATTAAG
AAAAAAGGAA CTCTTGATCC AGAACAAGAA ATCGAACGAA ATTGGTCAAT TATTGGGACA
AATTTTTGATG AAAAATGGCG TGCCAAAGCA ATCGAATTAG TGAATGACGG CACTCTTCAA
ATTCCGACTT CTCCTGATGG ACGTACACCA AACGCCGCCG CTATTACGAA ACAAGATGTC
CGTAATGCGG GCTTTGATTT AGATAATGCA TATACCATTA TGCACACAAA TGACGTTCAT
GGCCGACTAG AAGCAGGGAA AGGCGAATTA GGTATGGCGC GTCAAAAAC CTTTAAAGAC
CAAGAAACC CAACCTTGAT GGTGGATGCA GGGGATGTTT TCCAAGGATT ACCAATCTCC
AATTTCTCCA AAGGCGCGGA TATGGCCAAA CAATGAATG AAGTTGGTTA TGATGCCATG
GCGGTGGGAA ATCACGAGTT TGATTTTGGT TTAGAGATTG CACTAGGTTA TAAAGACCAA
CTGAATTTTC CGATTTTATC TAGTAATACG TATTACAAAG ATGGCAGTGG ACGGGTTTTT
GATCCGTATA CAATCGTAGA AAAATCCGGG AAAAAGTTTG CCATTGTAGG TGTGACGACC
CCAGAAACAG CAACGAAAAC ACACCCGAAA AACGTAGAGA AGGTGACATT TAAAGACCCG
```

TABLE 1-continued

Nucleotide and Amino Acid Seqeuences of E. faecalis Genes.

```
ATTCCAGAAG TAGAAGCAGT GATTAAGGAA ATTAAAGAGA AGTACGCGGA TATNCAAGCT
TTCGTGGTTA CTGGGCATTT AGGCGTAGAT GAAACGACGC CGCATATCTG GCGTGGTGAT
ACGCTAGCAG AAACCCTTAG TCAAACATAT CCTGAGTTAG ATATCACTGT GATTGATGGA
CATTCGCATA CAGCCGTCGA AAGTGGCAAA CGTTATGGCA AAGTGATCTA TGCTCAAACA
GGTAATTATT TAAATAATGT TGGGATCGTC ACAGCACCAG AGAGTGAACC AACTAAGAAA
ACAACAAAAT TGATTTCAGC AGCAGAGCTG CTAGAATTGC CAGAAAACCC GGCAGTTAAA
GCCATCGTTG ATGAAGCACG TACGAATTTT AACGCTGAAA ATGAAAAAGT AATTGTCGAT
TATATTCCAT TCACATTGGA TGGACAACGA GAAAATGTGC GCACACGAGA GACCAACTTA
GGGAATTTGA TTGGTGATGC GATTATGTCA TATGGCCAAG ACGCGTTTAG CCAACCTGCT
GATTTTGCAG TAACTAATGG TGGCGGCATT CGCGCTGATA TTAAACAAGG GCCAATTAAA
GTTGGGGATG TCATTGCTGT GTTACCTTTT GGCAATAGCA TTGCGCAAAT TCAAGTAACC
GGCGCCCAAG TTAAAGAAAT GTTTGAAATG TCTGTTCGTT CGATTCCACA AAAAGATGAG
AATGGCACAA TTTTACTAGA TGATGCTGGC CAACCAAAAC TTGGCGCAAA TGGTGGTTTC
CTACATGTTT CAAGCTCCAT TCGTATCCAC TATGATTCCA CAAAACCAGG TACTCGCTTG
GCTAGTGACG AAGGCAATGA AACAGGACAA ACGATTGTCG GTAGTCGCGT ATTAGGAATA
GAAATTAAAA ATCGGCAAAC ACAAAAGTTT GAACCATTGG ATGAGAAGAA ACAATACCGG
ATGGCTACCA ATGATTTCTT AGCTGCTGGT GGTGATGGTT ACGATGTGCT AGGTGGTGAA
CGAGAAGAAG GGATTTCACT AGATTCTGTC TTAATTGAAT ACTTGAAAAG TGCAACCAGC
TTGCGGTTGT ATCGTGCAGC AACGACGATT GATTTAGCAC AATATAAAGA ACCATTCCCA
GGCGAACGAA TTGTTTCTAT TTCGGAAGAA GCTTACAAAG AGTTAATCGG TGGAGGAGAG
ACGCCAAAAC CAGATCCAAA ACCAGACCCG AAACCAACAC CAGAAACACC AGTAGCAACC
AATAAACAAA ACCAAGCGGG AGCAAGACAG AGCAATCCAT CCGTAACAGA GAAGAAAAAG
TATGGCGGCT TTTTACCTAA AACGGGTACA GAAACAGAAA CGCTTGCATT ATATGGTTTA
CTGTTCGTTG GACTTTCTTC TTCTGGCTGG TATATTTATA AACGACGTAA CAAAGCTAGT
TAG

EF122-2 (SEQ ID NO:454)
VKKL SFKKVKWGMH FLMAVALIAP SVTSTAYAVE TTSQQSSEAV TSTTDSSRKQ
EPVITQETTD IKQEAPNQAT SDSVKQSQET TAPTETTNLE TSIAEKEETS TPQKITILGT
SDVHGQLWNW SYEDDKELPV GLSQVSTVVN QVRAQNPAGT VLIDNGDNIQ GTILTDDLYN
KAPLVNEKTH PMITAMNVMK YDAMVLGNHE FNFGLPLIKK IQQEATFPIL SANTYNKEDG
LRFVEGTTTK ELDFNQDGQP DLKVGIIGLT IPHIPLWDGP RVTSLNFLPL KEEAEKAVTE
LKANDQADII VASIHAGQQN SDPAASADQV IENVAGIDAY ILGHDHLSFT KQGAAPNGKT
VPVGGPKDTG TEVVKIDLSV AKNADKWEVQ EGTATIVPTT NVPADEAVKA ATKEYHEKTR
AFIQEEIGTA TADFLPKQEI KGIPEAQLQP TAMISLINNV QKEVTGAQLS AAALFKYDSK
LPAGKISYAT IFDIYKYPNT LVSVPINGEN LLKYLEKQGA YYNQTQPDDL TISFNPNIRV
YNYDMISGVD YKIDISKPVG ERIVDAKIDG QPLDPAKEYT IAMNNYRYGG LASQGIQVGE
PIKNSDPETL RGMIVDYIKK KGTLDPEQEI ERNWSIIGTN FDEKWRAKAI ELVNDGTLQI
PTSPDGRTPN AAAITKQDVR NAGFDLDNAY TIMHTNDVHG RLEAGKGELG MARLKTFKDQ
ENPTLMVDAG DVFQGLPISN FSKGADMAKA MNEVGYDAMA VGNHEFDFGL EIALGYKDQL
NFPILSSNTY YKDGSGRVFD PYTIVEKSGK KFAIVGVTTP ETATKTHPKN VEKVTFKDPI
PEVEAVIKEI KEKYADXQAF VVTGHLGVDE TTPHIWRGDT LAETLSQTYP ELDITVIDGH
SHTAVESGKR YGKVIYAQTG NYLNNVGIVT APESEPTKKT TKLISAAELL ELPENPAVKA
IVDEARTNFN AENEKVIVDY IPFTLDGQRE NVRTRETNLG NLIGDAIMSY GQDAFSQPAD
FAVTNGGGIR ADIKQGPIKV GDVIAVLPFG NSIAQIQVTG AQVKEMFEMS VRSIPQKDEN
GTILLDDAGQ PKLGANGGFL HVSSSIRIHY DSTKPGTRLA SDEGNETGQT IVGSRVLGIE
IKNRQTQKFE PLDEKKQYRM ATNDFLAAGG DGYDMLGGER EEGISLDSVL IEYLKSATSL
RLYRAATTID LAQYKEPFPG ERIVSISEEA YKELIGGGET PKPDPKPDPK PTPETPVATN
KQNQAGARQS NPSVTEKKKY GGFLPKTGTE TETLALYGLL FVGLSSSGWY IYKRRNKAS

EF122-3 (SEQ ID NO:455)
TG AAAAATGGCG TGCCAAAGCA ATCGAATTAG TGAATGACGG CACTCTTCAA
ATTCCGACTT CTCCTGATGG ACGTACACCA AACGCCGCCG CTATTACGAA ACAAGATGTC
CGTAATGCGG GCTTTGATTT AGATAATGCA TATACCATTA TGCACACAAA TGACGTTCAT
GGCCGACTAG AAGCAGGGAA AGGCGAATTA GGTATGGCGC GTCTAAAAAC CTTTAAAGAC
CAAGAAAACC CAACCTTGAT GGTGGATGCA GGGGATGTTT TCCAAGGATT ACCAATCTCC
AATTTCTCCA AAGGCGCGGA TATGGCCAAA GCAATGAATG AAGTTGGTTA TGATGCCATG
GCGGTGGGAA ATCACGAGTT TGATTTTGGT TTAGAGATTG CACTAGGTTA TAAAGACCAA
CTGAATTTTC CGATTTTATC TACTAATACG TATTACAAAG ATGGCAGTGG ACGGGTTTTT
GATCCGTATA CAATCGTAGA AAAATCCGGG AAAAAGTTTG CCATTGTAGG TGTGACGACC
CCAGAAACAG CAACGAAAAC ACACCCGAAA AACGTAGAGA AGGTGACATT TAAAGACCCG
ATTCCAGAAG TAGAAGCAGT GATTAAGGAA ATTAAAGAGA AGTACGCGGA TATNCAAGCT
TTCGTGGTTA CTGGGCATTT AGGCGTAGAT GAAACGACGC CGCATATCTG GCGTGGTGAT
ACGCTAGCAG AAACCCTTAG TCAAACATAT CCTGAGTTAG ATATCACTGT GATTGATGGA
CATTCGCATA CAGCCGTCGA AAGTGGCAAA CGTTATGGCA AAGTGATCTA TGCTCAAACA
GGTAATTATT TAAATAATGT TGGGATCGTC ACAGCACCAG AGAGTGAACC AACTAAGAAA
ACAACAAAAT TGATTTCAGC AGCAGAGCTG CTAGAATTGC CAGAAAACCC GGCAGTTAAA
GCCATCGTTG ATGAAGCACG TACGAATTTT AACGCTGAAA ATGAAAAAGT AATTGTCGAT
TATATTCCAT TCACATTGGA TGGACAACGA GAAAATGTGC GCACACGAGA GACCAACTTA
GGGAATTTGA TTGGTGATGC GATTATGTCA TATGGCCAAG ACGCGTTTAG CCAACCTGCT
GATTTTGCAG TAACTAATGG TGGCGGCATT CGCGCTGATA TTAAACAAGG GCCAATTAAA
GTTGGGGATG TCATTGCTGT GTTACCTTTT GGCAATAGCA TTGCGCAAAT TCAAGTAACC
GGCGCCCAAG TTAAAGAAAT GTTTGAAATG TCTGTTCGTT CGATTCCACA AAAAGATGAG
AATGGCACAA TTTTACTAGA TGATGCTGGC CAACCAAAAC TTGGCGCAAA TGGTGGTTTC
CTACATGTTT CAAGCTCCAT TCGTATCCAC TATGATTCCA CAAAACCAGG TACTCGCTTG
GCTAGTGACG AAGGCAATGA AACAGGACAA ACGATTGTCG GTAGTCGCGT ATTAGGAATA
GAAATTAAAA ATCGGCAAAC ACAAAAGTTT GAACCATTGG ATGAGAAGAA ACAATACCGG
```

TABLE 1-continued

Nucleotide and Amino Acid Seqeuences of E. faecalis Genes.

ATGGCTACCA ATGATTTCTT AGCTGCTGGT GGTGATGGTT ACGATATGCT AGGTGGTGAA
CGAGAAGAAG GGATTTCACT AGATTCTGTC TTAATTGAAT ACTTGAAAAG TGCAACCAGC
TTGCGGTTGT ATCGTGCAGC AACGACGATT GATTTAGCAC AATATAAAGA ACCATTCCCA
GGCGAACGAA TTGTTTCTAT TTCGGAAGAA GCTTACAAAG AGTTAATCGG TGGAGGAGAG
ACGCCAAAAC CAGATCCAAA ACCAGACCCG AAACCAACAC CAGAAACACC AGTAGCAACC
AATAAACAAA ACCAAGCGGG AGCAAGACAG AGCAATCCAT CCGTAACAGA GAAGAAAAAG
TATGGCGGCT TT

EF122-4 (SEQ ID NO:456)
EKWRAKAI ELVNDGTLQI
PTSPDGRTPN AAAITKQDVR NAGFDLDNAY TIMHTNDVHG RLEAGKGELG MARLKTFKDQ
ENPTLMVDAG DVFQGLPISN FSKGADMAKA MNEVGYDAMA VGNHEFDFGL EIALGYKDQL
NFPILSSNTY YKDGSGRVFD PYTIVEKSGK KFAIVGVTTP ETATKTHPKN VEKVTFKDPI
PEVEAVIKEI KEKYADXQAF VVTGHLGVDE TTPHIWRGDT LAETLSQTYP ELDITVIDGH
SHTAVESGKR YGKVIYAQTG NYLNNVGIVT APESEPTKKT TKLISAAELL ELPENPAVKA
IVDEARTNFN AENEKVIVDY IPFTLDGQRE NVRTRETNLG NLIGDAIMSY GQDAFSQPAD
FAVTNGGGIR ADIKQGPIKV GDVIAVLPFG NSIAQIQVTG AQVKEMFEMS VRSIPQKDEN
GTILLDDAGQ PKLGANGGFL HVSSSIRIHY DSTKPGTRLA SDEGNETGQT IVGSRVLGIE
IKNRQTQKFE PLDEKKQYRM ATNDFLAAGG DGYDMLGGER EEGISLDSVL IEYLKSATSL
RLYRAATTID LAQYKEPFPG ERIVSISEEA YKELIGGGET PKPDPKPDPK PTPETPVATN
KQNQAGARQS NPSVTEKKKY GGF

EF123-1 (SEQ ID NO:457)
TAAAATAAAA AATTGGTACG AAGTGAACGT TCTCTTCTAT GTGTCGTTAG TAGAGGAAGG
ATGAAAGAAA TGAGAAAGAA TGGTCCAATG GTAAACCGTT GGCTCTACGG GTTGATGTGT
TTGTTACTTG TTCTAAATTA TGGCACACCA CTCATGGCTT TGGCGGAAGA GGTTAACAGC
GATGGCCAGT TAACGTTAGG AGAAGTGAAG CAAACCAGCC AGCAAGAAAT GACCTTAGCG
CTTCAAGGAA AAGCACAACC AGTAACACAA GAGGTTGTAG TGCATTATAG TGCCAATGTG
TCAATCAAAG CTGCACATTG GGCAGCGCCC AATAATACGG GCAAGATTCA AGTGGATGAC
CAGAAGAAAC AGATTCAAAT TGAATTGAAT CAGCAAGCGT TAGCAGATAC GTTAGTCTTA
ACGTTGAACC CTACAGCTAC AGAAGATGTG ACGTTTTCTT ATGGACAACA GCAACGAGCG
TTGACGTTAA AGACTGGTAC TGATCCGACA GAATCAACGG CAATCACGAG TTCGCCAGCC
GCATCAGCGA ATGAAGGTTC AACAGAAGAA GCATCTACAA ACTCCTCTGT TCCTCGTTCG
TCCGAAGAAA CTGTCGCCAG CACGACAAAA GCGATAGAAA GTAAAACAAC TGAATCGACA
ACTGTCAAAC CGCGCGTAGC AGGACCAACA GATATCAGTG ATTATTTTAC AGGTGATGAA
ACAACGATTA TCGATAATTT TGAAGATCCG ATTTATTTAA ATCCTGATGG AACACCAGCA
ACACCGCCGT ATAAAGAAGA TGTGACCATT CATTGGAACT TAACTGGTC GATTCCAGAA
GATGTGCGAG AACAAATGAA AGCAGGCGAT TACTTCGAGT TTCAATTACC TGGCAATTTG
AAACCTAATA AACCAGGTTC AGGTGATTTA GTTGATGCGA CAAGGCAATGT CTATGGAACC
TACACAATTA GTGAAGATGG TACGGTTCGT TTTACCTTTA ATGAGCGAAT CACGTCTGAA
AGTGACATTC ACGGGGACTT TTCTTTAGAT ACTCATTTGA ATGATTCAGA TGGGCGGGGC
CCAGGAGATT GGGTGATTGA TATTCCTACA CAAGAAGATT TGCCGCCTGT AGTGATTCCA
ATTGTCCCAG ATACCGAACA ACAAATTGAT AAACAAGGCC ATTTTGATCG AACGCCCAAT
CCTAGTGCGA TTACTTGGAC GGTAGATATC AATCAAGCGA TGAAAGATCA AACAAATCCA
ACTGTGACGG AAACATGGCC AACAGGGAAT ACCTTTAAGT CCGTGAAAGT CTATGAGTTA
GTGATGAATC TTGATGGAAC AATTAAAGAA GTGGGTCGCG AACTTAGTCC AGATGAATAT
ACCGTTGATA AAAATGGCAA TGTGACGATT AAAGGTGACA CCAACAAAGC GTATCGTCTT
GAGTACCAAA CGACGATTGA CGAGGCGGTT ATTCCAGATG GCGGCGGCGA TGTGCCTTTT
AAAAATCACG CGACGTTAAC AAGTGATAAT AATCCAAATG GGTTAGATGC TGAAGCAACT
GTTACCGCCA CATATGGCAA AATGTTAGAC AAGCGCAATA TAGATTACGA CGAAGCCAAT
CAAGAATTCA CTTGGGAAAT TAACTACAAC TATGGTGAAC AAACCATTCC AAAAGACCAA
GCAGTCATTA CAGACACAAT GGGGGATAAT TTAACGTTTG AACCAGATTC TTTACATTTA
TATTCAGTGA CATTTGATGA CAAAGGAAAT GAAGTCGTTG GAGCAGAACT TGTGGAAGGA
AAAGATTACA AAGTGGTAAT CAACGGAGAC GGTTCCTTTG CAATTGACTT TTTACATGAT
GTGACTGGCG CAGTCAAGAT TGATTATAAA ACCAAAGTTG ATGGAATTGT CGAAGGCGAT
GTTGCCGTGA ATAATCGTGT GGATGTTGGC ACTGGTCAGC ATTCAGAAGA TGATGGCACA
GCCAGTCAAC AAAATATTAT TAAAAACACT GGTGCAGTTG ATTATCAAAA TTCAACGATT
GGTTGGACGT TAGCTGTGAA TCAAAATAAT TATTTGATGG AAAATGCCGT GATTACGGAT
ACGTACGAAC CAGTTCCTGG CTTAACTATG GTACCCAATT CGTTGGTTGT CAAAGATACA
ACCACTGGTG CTCAGTTGAC GTTAGGCAAG GATTTCATGG TAGAAATAAC TAGTAATGCA
GATGGTGAAA CAGGCTTTAA GGTAAGTTTT ATAGGGGCGT ATGCCAAAAC AAGTGATGCC
TTCCACATAA CTTATACTAC CTTTTTCGAT GTTACCGAGT TAGACGCTAA CAATCCTGCG
TTGGACCATT ATCGAAATAC CGCTGCCATT GATTGGACGG ATGAAGCAGG AAACAATCAT
CATTCAGAAG ATAGTAAACC GTTTAAACCT TTACCTGCTT TTGATTTAAA TGCGCAAAAA
AGCGGTGTTT ACAATGCCGT CACCAAAGAA ATCACTTGGA CGATTGCGGT TAATTTAAGT
AATAATCGTT TAGTCGACGC CTTTTTGACG GATCCAATTT TAACCAATCA AACCTATTTG
GCTGGGAGCT TGAAAGTCTA TGAAGGCAAT ACAAAGCCAG ATGGTTCGGT TGAAAAAGTG
AAACCAACGC AACCGTTGAC GGATATCACA ATGGAAGAAC CAAGCGAGAA AAACCAAAAT
ACTTGGCGTG TTGATTTTCC TAATGATAGT CGTACGTATG TGATTGAATT TAAGACGTCT
GTTGATGAAA AAGTTATCGA AGGTTCGGCT AGTTATGACA ATACCGCATC TTATACAAAC
CCAGGTTCTT CACGTGATGT GACAGGGAAA GTTTCTATTC AACATGGTGG CGAATCAGTG
AAAAAAGGTG GCGAATACCA CAAAGATGAT CCAGATCATG TGTACTGGCA TGTAATGATC
AATGGCGCCC AATCGGTTTT AGACGATGTG GTTATTACTG ATACACCCTC ACCAAACCAA
GTGCTAGATC CCGAGTCATT GGTGATTTAC GGTACCAACG TAACAGAAGA CGGAACTATT
ACGCCAGATA AATCTGTTAT TTTAGAAGAA GGAAAGATT ACACACTGGA AGTTACCACC
GATAATGAAA CAGGACAACA AAAAATTGTC GTTAAAATGG CCCATATTGA AGCACCTTAT
TATATGGAAT ATCGTAGTTT AGTGACTTCT TCAGCGGCGG GGAGTACAGA CACGGTATCC

TABLE 1-continued

Nucleotide and Amino Acid Seqeuences of E. faecalis Genes.

```
AACCAAGTGT CAATTACTGG AAATGGTTCA GAAGTCGTTC ATGGGGATGA CAATGGCGAT
GTGGTCGTTG ACATTGATCA CAGTGGCGGG CATGCCACAG GGACTAAAGG CAAAATTCAG
CTGAAGAAAA CAGCCATGGA TGAGACGACT ATTTTAGCAG GCGCCCATTT CCAAATTTGG
GACCAAGCTA AAACACAAGT CCTACGTGAA GGTACAGTAG ATGCCACCGG GGTTATCACA
TTTGGTGGGT TGCCACAAGG GCAATACATT TTGGTGGAGA CAAAAGCACC AGAAGGCTAT
ACAGTTTCGG ACGAATTAGC TAAAGGCCGA GTCATTACTA TTGATGAAGA AACTTACGCC
GAAGGAGCAC AACCAACCAT TATTAAAAAC GATGTCAATA AGTATTTTT AGAAAAAATG
GATGAGAAGG GTAAAAAGTT AGTCAATGCT CGCTTTAAAT TAGAGCATGC CGTAACCACG
CCGTTTACTC ATTGGGAAGA AGTTCCCCTT GCGCCGGATC GAACCAACGC GAATGGCCAG
TTAGAGGTGG ATAGTTTAAA ACCAGGGCTT TATCAGTTCA CAGAAATCGA AGCACCGACA
GGCTATCTTT TAGACACGAC CCCCAAACGA TTCATCGTGA CACAAAATAC GAGCGGACAA
ATTCGTGATG TTCATGTCAA AATGCTTAAT TACCAAGGTT CTGCTGAACT AATTAAAAAA
GACCAAGCAG GCAATCCATT AGCAGGTGCT GAATTTTCAG TCCTTGACAC CACAGGACAA
GCAGTTCGAG AACACTTAGT TTCGGATGCA AACGGAAAAG TCACAGTGAC GGATTTAGCC
CCAGGAAAAT ATCAATTTGT GGAAACCAAA GCGCCAGCAG GGTACCTTTT AAACACTGAA
CCAAGTGCTT TCACGATTGC AGCAAGCGAT CGGGGCAAAC CAGCAACAGT TATAGCAACG
GCTAACTTTG TTAACTATCA AGGCACGGCT AAATTAATCA AAAAAGATGT GAATGGACAC
TTATTAAGTG GTGCGACATT TAAAGTGCTT GATGCGAAGG GAGAAACGAT TCAAACAGGC
TTGACGACAA ATAATCAAGG GGAAATTGTT GCAGAGCACT TAGCCCCAGG AAAATATCGC
TTTGTAGAAA CCAAAGCGCC AACAGGCTAT TTATTAAATA CCACGCCAGT CCCATTTGAA
ATTGCTGAGA AAAATGCTGG TAAACCAGCG GTCGTGGTTG CTAGTGACAA GTTTGTGAGT
TACAAAGGGG CTTTCCAAAT CGTGAAAACG AATAGCGCAG ACCAACCATT AGCAGGTGCT
GTTTTTGAAT TATATGATCA CAATAAACAA TCATTAGGGA TTACAGCAAC GAGTGGCAAA
GATGGCAAAA TTATCTTTAG AGACTTGGCG CCAGGTACCT ATTATTACAA AGAAATCAAA
GCACCAAAAT TACCAGATGG CGCAGATTAT ATTATTTATC CTGAATTAGT AAAAGTAGAA
ATTCGTGGTG ATTTCAAAGG TGATCCGGAG ATTTTCCAAT TAGGGCCTT CGCCAATTTC
AAAGGACGCG CCGTCTTTAA GAAAATTGAT GCCAATGCGA ACCCACTTCC AGGAACGATT
TTTAAATTGT ATCGAATCGA AAACGGGGAA AAAATCTTTG AAAGAGAAGT AACTGCTGAA
AAAGATGGTT CATTGGCTAT GGAGGATTTA GGTGCTGGTA GCTATGAATT AGATGAACTG
GATGCAACGG ATGGCTATAT CGTCAATAAA CAACCCATTT ATTTTGTAGT GAAGAAGAAT
TCAAATGATA AACAACCACT AGATGAGTTA GAGTTTGTAA ATTATCAAGC AGAAGTAATG
GGACGTAAAG TCAACGAGCA AGGTCAAACC TTAGCGGGTG CAGTTTTTGC AATTTACAAT
GCCGATGAGC AGAATCAGCC CCAAGGTTCA CCGATAACAT TCTTGAATCG TGCAGGAGAA
AAAGTTTCTG AAATAACAAC GGATAAGACT GGCGAAATTT ACGCTAAAGG GCTAAATGAA
GGGCATTACG TTTTAGTGGA AACGAAAGCA CCAACAGGCT ATCTGTTAGA CACAACGCTA
CATCCATTTG ATGTAACCGC CCAATTAGGA AAAGAGCAGC CAATTGCTTT AGGCGATCTT
ATCAATTATC AAGGAACTGC TCAATTAACC AAAGAAAACG AAACAGGTGA AGCATTGGCA
GGTGCGGTGT TTAAGGTCAT TGATGAAACA GGGCAAACCG TAGATGGACA AACCAATCTG
ATGTCTGACA AGCAAGGCAA AGTCATTGCG AAAAACTTAG CACCGGGAAC GTATCGTTTT
GTGGAGACAC AAGCGCCAAC TAGCTATCTT CTTAATGAAA CGCCAAGCGC AAGCTTTACG
ATTGCCAAAG ACAACCAAGG CAAACCAGCC ACTGTGGTAC TTAAAGCACC TTTTATTAAT
TACCAAGGTG CTGCCAAGCT GGTGAAAATT GATCAGCAAA AGAATGCCTT AGCAGGTCCT
GAATTTAAAG TGACAGATGC AGAGACAGGG CAAACTGTCG CTCGTTCATT ACGTTCTGAC
AACCAAGGGT TAGTTCAAGT GAACCACTTA CAACCAGGAA AATATACCTT TGTGGAAACA
AAAGCACCGG ATGGTTACCA ACTGTCTAAG CAAGCTGTCG CATTCACTAT TGCGGCAACA
GCGAAAGACA AACCTGAACT CGTGAATGCG GGCACGTTTG TTAACGAGAA ACAACCTGTA
TCCAAAAAAA CAAAACCAAA TCAGCCAACA ACGAAACAAG CAGCTAGAGA GACAGGTTGG
CTTGGTTTAC CGAAAACCAA CACACAAGTC AATTACTTCT TTGTCTTTAT CGGCCTCATG
TTGGTCGGTT TGGCAAGTTG GCTCTTCTAT AAAAAGAGCA AGAAATAA
```

EF123-2 (SEQ ID NO:458)
MRKNGPMV NRWLYGLMCL LLVLNYGTPL MALAEEVNSD
GQLTLGEVKQ TSQQEMTLAL QGKAQPVTQE VVVHYSANVS IKAAHWAAPN NTRKIQVDDQ
KKQIQIELNQ QALADTLVLT LNPTATEDVT FSYGQQQRAL TLKTGTDPTE STAITSSPAA
SANEGSTEEA STNSSVPRSS EETVASTTKA IESKTTESTT VKPRVAGPTD ISDYFTGDET
TIIDNFEDPI YLNPDGTPAT PPYKEDVTIH WNFNWSIPED VREQMKAGDY FEFQLPGNLK
PNKPGSGDLV DAEGNVYGTY TISEDGTVRF TFNERITSES DUHGDFSLDT HLNDSDGRGP
GDWVIDIPTQ EDLPPVVIPI VPDTEQQIDK QGHFDRTPNP SAITWTVDIN QAMKDQTNPT
VTETWPTGNT FKSVKVYELV MNLDGTIKEV GRELSPDEYT VDKNGNVTIK GDTNKAYRLE
YQTTIDEAVI PDGGGDVPFK NHATLTSDNN PNGLDAEATV TATYGKMLDK RNIDYDEANQ
EFTWEINYNY GEQTIPKDQA VITDTMGDNL TFEPDSLHLY SVTFDDKGNE VVGAELVEGK
DYKVVINGDG SFAIDFLHDV TGAVKIDYKT KVDGIVEGDV AVNNRVDVGT GQHSEDDGTA
SQQNIIKNTG AVDYQNSTIG WTLAVNQNNY LMENAVITDT YEPVPGLTMV PNSLVVKDTT
TGAQLTLGKD FMVEITRNAD GETGFKVSFI GAYAKTSDAF HITYTTFFDV TELDANNPAL
DHYRNTAAID WTDEAGNNHH SEDSKPFKPL PAFDLNAQKS GVYNAVTKEI TWTIAVNLSN
NRLVDAFLTD PILTNQTYLA GSLKVYEGNT KPDGSVEKVK PTQPLTDITM EEPSEKNQNT
WRVDFPNDSR TYVIEFKTSV DEKVIEGSAS YDNTASYTNQ GSSRDVTGKV SIQHGGESVK
KGGEYHKDDP DHVYWHVMIN GAQSVLDDVV ITDTPSPNQV LDPESLVIYG TNVTEDGTIT
PDKSVILEEG KDYTLEVTTD NETGQQKIVV KMAHIEAPYY MEYRSLVTSS AAGSTDTVSN
QVSITGNGSE VVHGDDNGDV VVDIDHSGGH ATGTKGKIQL KKTAMDETTI LAGAHFQIWD
QAKTQVLREG TVDATGVITF GGLPQGQYIL VETKAPEGYT VSDELAKGRV ITIDEETSAE
GAQPTIIKND VNKVFLEKMD EKGKKLVNAR FKLEHAVTTP FTHWEEVPLA PDRTNANGQL
EVDSLKPGLY QFTEIEAPTG YLLDTTPKRF IVTQNTSGQI RDVHVKMLNY QGSAELIKKD
QAGNPLAGAE FSVLDTTGQA VREHLVSDAN GKVTVTDLAP GKYQFVETKA PAGYLLNTEP
SAFTIAASDR GKPATVIATA NFVNYQGTAK LIKKDVNGHL LSGATFKVLD AKGETIQTGL
TTNNQGEIVA EHLAPGKYRF VETKAPTGYL LNTTPVPFEI AEKNAGKPAV VVASDNFVSY
KGAFQIVKTN SADQPLAGAV FELYDHNKQS LGITATSGKD GKIIFRDLAP GTYYYKEIKA

TABLE 1-continued

Nucleotide and Amino Acid Seqeuences of E. faecalis Genes.

PKLPDGADYI IYPELVKVEI RGDFKGDPEI FQLGAFANFK GRAVFKKIDA NANPLPGTIF
KLYRIENGEK IFEREVTAEK DGSLAMEDLG AGSYELDELD ATDGYIVNKQ PIYFVVKKNS
NDKQPLDELE FVNYQAEVMG RKVNEQGQTL AGAVFAIYNA DEQNQPQGSP ITFLNRAGEK
VSEITTDKTG EIYAKGLNEG HYVLVETKAP TGYLLDTTLH PFDVTAQLGK EQPIALGDLI
NYQGTAQLTK ENETGEALAG AVFKVIDETG QTVDGQTNLM SDKQGKVIAK NLAPGTYRFV
ETQAPTSYLL NETPSASFTI AKDNQGKPAT VVLKAPFINY QGAAKLVKID QQKNALAGAE
FKVTDAETGQ TVARSLRSDN QGLVQVNHLQ PGKYTFVETK APDGYQLSKQ AVAFTIAATA
KDKPELVNAG TFVNEKQPVS KKTKPNQPTT KQAARETGWL GLPKTNTQVN YFFVFIGLML
VGLASWLFYK KSKK

EF123-3 (SEQ ID NO:459)
GGAAGA GGTTAACAGC
GATGGCCAGT TAACGTTAGG AGAAGTGAAG CAAACCAGCC AGCAAGAAAT GACCTTAGCG
CTTCAAGGAA AAGCACAACC AGTAACACAA GAGGTTGTAG TGCATTATAG TGCCAATGTG
TCAATCAAAG CTGCACATTG GGCAGCGCCC AATAATACGC GCAAGATTCA AGTGGATGAC
CAGAAGAAAC AGATTCAAAT TGAATTGAAT CAGCAAGCGT TAGCAGATAC GTTAGTCTTA
ACGTTGAACC CTACAGCTAC AGAAGATGTG ACGTTTTCTT ATGGACAACA GCAACGAGCG
TTGACGTTAA AGACTGGTAC TGATCCGACA GAATCAACGG CAATCACGAG TTCGCCAGCC
GCATCAGCGA ATGAAGGTTC AACAGAAGAA GCATCTACAA ACTCCTCTGT TCCTCGTTCG
TCCGAAGAAA CTGTCGCCAG CACGACAAAA GCGATAGAAA GTAAAACAAC TGAATCGACG
ACTGTCAAAC CGCGCGTAGC AGGACCAACA GATATCAGTG ATTATTTTAC AGGTGATGAA
ACAACGATTA TCGATAATTT TGAAGATCCG ATTTATTTAA ATCCTGATGG AACACCAGCA
ACACCGCCGT ATAAAGAAGA TGTGACCATT CATTGGAACT TTAACTGGTC GATTCCAGAA
GATGTGCGAG AACAAATGAA AGCAGGCGAT TACTTCGAGT TCAATTACC TGGCAATTTG
AAACCTAATA AACCAGGTTC AGGTGATTTA GTTGATGCAG AAGGCAATGT CTATGGAACC
TACACAATTA GTGAAGATGG TACGGTTCGT TTTACCTTTA ATAGCGAAT CACGTCTGAA
AGTGACATTC ACGGGGACTT TTCTTTAGAT ACTCATTTGA ATGATTCAGA TGGGCGGGGC
CCAGGAGATT GGGTGATTGA ATAACCTACA CAAGAAGATT TGCCGCCTGT AGTGATTCCA
ATTGTCCCAG ATACCGAACA ACAAATTGAT AAACAAGGCC ATTTTGATCG AACGCCCAAT
CCTAGTGCGA TTACTTGGAC GGTAGATATC AATCAAGCGA TGAAAGATCA AACAAATCCA
ACTGTGACGG AAACATGGCC AACAGGGAAT ACCTTTAAGT CCGTGAAAGT CTATGAGTTA
GTGATGAATC TTGATGGAAC AATTAAAGAA GTGGGTCGCG AACTTAGTCC AGATGAATAT
ACCGTTGATA AAAATGGCAA TGTGACGATT AAAGGTGACA CCAACAAAGC GTATCGTCTT
GAGTACCAAA CGACGATTGA CGAGGCGGTT ATTCCAGATG GCGGCGGCGA TGTGCCTTTT
AAAAATCACG CGACGTTAAC AAGTGATAAT AATCCAAATG GGTTAGATGC TGAAGCAACT
GTTACCGCCA CATATGGCAA AATGTTAGAC AAGCGCAATA TAGATTACGA CGAAGCCAAT
CAAGAATTCA CTTGGGAAAT TAACTACAAC TATGGTGAAC AAACCATTCC AAAAGACCAA
GCAGTCATTA CAGACACAAT GGGGGATAAT TTAACGTTTG AACCAGATTC TTTACATTTA
TATTCAGTGA CATTTGATGA CAAAGGAAAT GAAGTCGTTG GAGCAGAACT TGTGGAAGGA
AAAGATTACA AAGTGGTAAT CAACGGAGAC GGTTCCTTTG CAATTGACTT TTTACATGAT
GTGACTGGCG CAGTCAAGAT TGATTATAAA ACCAAAGTTG ATGGAATTGT CGAAGGCGAT
GTTGCCGTGA ATAATCGTGT GGATGTTGGC ACTGGTCAGC ATTCAGAAGA TGATGGCACA
GCCAGTCAAC AAAATATTAT TAAAAACACT GGTGCAGTTG ATTATCAAAA TTCAACGATT
GGTTGGACGT TAGCTGTGAA TCAAAATAAT TATTTGATGG AAAATGCCGT GATTACGGAT
ACGTACGAAC CAGTTCCTGG CTTAACTATG GTACCCAATT CGTTGGTTGT CAAAGATACA
ACCACTGGTG CTCAGTTGAC GTTAGGCAAG GATTTCATGG TAGAAATAAC TCGTAATGCA
GATGGTGAAA CAGGCTTTAA GGTAAGTTTT ATAGGGGCGT ATGCCAAAAC AAGTGATGCC
TTCCACATAA CTTATACTAC CTTTTTCGAT GTTACCGAGT TAGACGCTAA CAATCCTGCG
TTGGACCATT ATCGAAATAC CGCTGCCATT GATTGG

EF123-4 (SEQ ID NO:460)
EEVNSD
GQLTLGEVKQ TSQQEMTLAL QGKAQPVTQE VVVHYSANVS IKAAHWAAPN NTRKIQVDDQ
KKQIQIELNQ QALADTLVLT LNPTATEDVT FSYGQQQRAL TLKTGTDPTE STAITSSPAA
SANEGSTEEA STNSSVPRSS EETVASTTKA IESKTTESTT VKPRVAGPTD ISDYFTGDET
TIIDNFEDPI YLNPDGTPAT PPYKEDVTIH WNFNWSIPED VREQMKAGDY FEFQLPGNLK
PNKPGSGDLV DAEGNVYGTY TISEDGTVRF TFNERITSES DIHGDFSLDT HLNDSDGRGP
GDWVIDIPTQ EDLPPVVIPI VPDTEQQIDK QGHFDRTPNP SAITWTVDIN QAMKDQTNPT
VTETWPTGNT FKSVKVYELV MNLDGTIKEV GRELSPDEYT VDKNGNVTIK GDTNKAYRLE
YQTTIDEAVI PDGGGDVPFK NHATLTSDNN PNGLDAEATV TATYGKMLDK RNIDYDEANQ
EFTWEINYNY GEQTIPKDQA VITDTMGDNL TFEPDSLHLY SVTFDDKGNE VVGAELVEGK
DYKVVINGDG SFAIDFLHDV TGAVKIDYKT KVDGIVEGDV AVNNRVDVGT GQHSEDDGTA
SQQNIIKNTG AVDYQNSTIG WTLAVNQNNY LMENAVITDT YEPVPGLTMV PNSLVVKDTT
TGAQLTLGKD FMVEITRNAD GETGFKVSFI GAYAKTSDAF HITYTTFFDV TELDANNPAL
DHYRNTAAID W

EF124-1 (SEQ ID NO:461)
TAAAATAAAA AATTGGTACG AAGTGAACGT TCTCTTCTAT GTGTCGTTAG TAGAGGAAGG
ATGAAAGAAA TGAGAAAGAA TGGTCCAATG GTAAACCGTT GGCTCTACGG GTTGATGTGT
TTGTTACTTG TTCTAAATTA TGGCACACCA CTCATGGCTT TGGCGGAAGA GGTTAACAGC
GATGGCCAGT TAACGTTAGG AGAAGTGAAG CAAACCAGCC AGCAAGAAAT GACCTTAGCG
CTTCAAGGAA AAGCACAACC AGTAACACAA GAGGTTGTAG TGCATTATAG TGCCAATGTG
TCAATCAAAG CTGCACATTG GGCAGCGCCC AATAATACGC GCAAGATTCA AGTGGATGAC
CAGAAGAAAC AGATTCAAAT TGAATTGAAT CAGCAAGCGT TAGCAGATAC GTTAGTCTTA
ACGTTGAACC CTACAGCTAC AGAAGATGTG ACGTTTTCTT ATGGACAACA GCAACGAGCG
TTGACGTTAA AGACTGGTAC TGATCCGACA GAATCAACGG CAATCACGAG TTCGCCAGCC
GCATCAGCGA ATGAAGGTTC AACAGAAGAA GCATCTACAA ACTCCTCTGT TCCTCGTTCG

TABLE 1-continued

Nucleotide and Amino Acid Seqeuences of E. faecalis Genes.

```
TCCGAAGAAA CTGTCGCCAG CACGACAAAA GCGATAGAAA GTAAAACAAC TGAATCGACG
ACTGTCAAAC CGCGCGTAGC AGGACCAACA GATATCAGTG ATTATTTTAC AGGTGATGAA
ACAACGATTA TCGATAATTT TGAAGATCCG ATTTATTTAA ATCCTGATGG AACACCAGCA
ACACCGCCGT ATAAAGAAGA TGTGACCATT CATTGGAACT TTAACTGGTC GATTCCAGAA
GATGTGCGAG AACAAATGAA AGCAGGCGAT TACTTCGAGT TTCAATTACC TGGCAATTTG
AAACCTAATA AACCAGGTTC AGGTGATTTA GTTGATGCAA AAGGCAATGT CTATGGAACC
TACACAATTA GTGAAGATGG TACGGTTCGT TTTACCTTTA ATGAGCGAAT CACGTCTGAA
AGTGACATTC ACGGGGACTT TTCTTTAGAT ACTCATTTGA ATGATTCAGA TGGGCGGGGC
CCAGGAGATT GGGTGATTGA TATTCCTACA CAAGAAGATT TGCCGCCTGT AGTGATTCCA
ATTGTCCCAG ATACCGAACA ACAAATTGAT AAACAAGGCC ATTTTGATCG AACGCCCAAT
CCTAGTGCGA TTACTTGGAC GGTAGATATC AATCAAGCGA TGAAAGATCA AACAAATCCA
ACTGTGACGG AAACATGGCC AACAGGGAAT ACCTTTAAGT CCGTGAAAGT CTATGAGTTA
GTGATGAATC TTGATGGAAC AATTAAAGAA GTGGGTCGCG AACTTAGTCC AGATGAATAT
ACCGTTGATA AAAATGGCAA TGTGACGATT AAAGGTGACA CCAACAAAGC GTATCGTCTT
GAGTACCAAA CGACGATTGA CGAGGCGGTT ATTCCAGATG GCGGCGGCGA TGTGCCTTTT
AAAAATCACG CGACGTTAAC AAGTGATAAT AATCCAAATG GGTTAGATGC TGAAGCAACT
GTTACCGCCA CATATGGCAA AATGTTAGAC AAGCGCAATA TAGATTACGA CGAAGCCAAT
CAAGAATTCA CTTGGGAAAT TAACTACAAC TATGGTGAAC AAACCATTCC AAAAGACCAA
GCAGTCATTA CAGACACAAT GGGGGATAAT TTAACGTTTG AACCAGATTC TTTACATTTA
TATTCAGTGA CATTTGATGA CAAAGGAAAT GAAGTCGTTG GAGCAGAACT TGTGGAAGGA
AAAGATTACA AAGTGGTAAT CAACGGAGAC GGTTCCTTTG CAATTGACTT TTTACATGAT
GTGACTGGCG CAGTCAAGAT TGATTATAAA ACCAAAGTTG ATGGAATTGT CGAAGGCGAT
GTTGCCGTGA ATAATCGTGT GGATGTTGGC ACTGGTCAGC ATTCAGAAGA TGATGGCACA
GCCAGTCAAC AAAATATTAT TAAAAACACT GGTGCAGTTG ATTATCAAAA TTCAACGATT
GGTTGGACGT TAGCTGTGAA TCAAAATAAT TATTTGATGG AAAATGCCGT GATTACGGAT
ACGTACGAAC CAGTTCCTGG CTTAACTATG GTACCCAATT CGTTGGTTGT CAAAGATACA
ACCACTGGTG CTCAGTTGAC GTTAGGCAAG GATTTCATGG TAGAAATAAC TCGTAATGCA
GATGGTGAAA CAGGCTTTAA GGTAAGTTTT ATAGGGGCGT ATGCCAAAAC AAGTGATGCC
TTCCACATAA CTTATACTAC CTTTTTCGAT GTTACCGAGT TAGACGCTAA CAATCCTGCG
TTGGACCATT ATCGAAATAC CGCTGCCATT GATTGGACGG ATGAAGCAGG AAACAATCAT
CATTCAGAAG ATAGTAAACC GTTTAAACCT TTACCTGCTT TTGATTTAAA TGCGCAAAAA
AGCGGTGTTT ACAATGCCGT CACCAAAGAA ATCACTTGGA CGATTGCGGT TAATTTAAGT
AATAATCGTT TAGTCGACGC CTTTTTGACG GATCCAATTT TAACCAATCA AACCTATTTG
GCTGGGAGCT TGAAAGTCTA TGAAGGCAAT ACAAAGCCAG ATGGTTCGGT TGAAAAAGTG
AAACCAACGC AACCGTTGAC GGATATCACA ATGAAGAAC CAAGCGAGAA AAACCAAAAT
ACTTGGCGTG TTGATTTTCC TAATGATAGT CGTACGTATG TGATTGAATT TAAGACGTCT
GTTGATGAAA AAGTTATCGA AGGTTCGGCT AGTTATGACA ATACCGCATC TTATACAAAC
CAAGGTTCTT CACGTGATGT GACAGGAAAA GTTTCTATTC AACATGGTGG CGAATCAGTG
AAAAAAGGTG GCGAATACCA CAAAGATGAT CCAGATCATG TGTACTGGCA TGTAATGATC
AATGGCGCCC AATCGGTTTT AGACGATGTG GTTATTACTG ATACACCCTC ACCAAACCAA
GTGCTAGATC CCGAGTCATT GGTGATTTAC GGTACCAACG TAACAGAAGA CGGAACTATT
ACGCCAGATA AATCTGTTAT TTTAGAAGAA GGAAAAGATT ACACACTGGA AGTTACCACC
GATAATGAAA CAGGACAACA AAAAATTGTC GTTAAAATGG CCCATATTGA AGCACCTTAT
TATATGGAAT ATCGTAGTTT AGTGACTTCT TCAGCGGCGG GGAGTACAGA CACGGTATCC
AACCAAGTGT CAATTACTGG AAATGGTTCA GAAGTCGTTC ATGGGGATGA CAATGGCGAT
GTGGTCGTTG ACATTGATCA CAGTGGCGGG CATGCCACAG GGACTAAAGG CAAAATTCAG
CTGAAGAAAA CAGCCATGGA TGAGACGACT ATTTTAGCAG GCGCCCATTT CCAAATTTGG
GACCAAGCTA AAACACAAGT CCTACGTGAA GGTACAGTAG ATGCCACCGG GGTTATCACA
TTTGGTGGGT TGCCACAAGG GCAATACATT TTGGTGGAGA CAAAAGCACC AGAAGGCTAT
ACAGTTTCGG ACGAATTAGC TAAAGGCCGA GTCATTACTA TTGATGAAGA AACTTCAGCC
GAAGGAGCAC AACCAACCAT TATTAAAAAC GATGTCAATA AAGTATTTTT AGAAAAAATG
GATGAGAAGG GTAAAAGTT AGTCAATGCT CGCTTTAAAT TAGAGCATGC CGTAACCACG
CCGTTTACTC ATTGGGAAGA AGTTCCCCTT GCGCCGGATC GAACCAACGC GAATGGCCAG
TTAGAGGTGG ATAGTTTAAA ACCAGGGCTT TATCAGTTCA CAGAAATCGA AGCACCGACA
GGCTATCTTT TAGACACGAC CCCCAAACGA TTCATCGTGA CACAAAATAC GAGCGGACAA
ATTCGTGATG TTCATGTCAA AATGCTTAAT TACCAAGGTT CTGCTGAACT AATTAAAAAA
GACCAAGCAG GCAATCCATT AGCAGGTGCT GAATTTTCAG TCCTTGACAC CACAGGACAA
GCAGTTCGAG AACACTTAGT TTCGGATGCA AACGAAAAAG TCACAGTGAC GGATTTAGCC
CCAGGAAAAT ATCAATTTGT GGAAACCAAA GCGCCAGCAG GGTACCTTTT AAACACTGAA
CCAAGTGCTT TCACGATTGC AGCAAGCGAT CGGGGCAAAC CAGCAACAGT TATAGCAACG
GCTAACTTTG TTAACTATCA AGGCACGGCT AAATTAATCA AAAAAGATGT GAATGGACAC
TTATTAAGTG GTGCGACATT TAAAGTGCTT GATGCGAAGG GAGAAACGAT TCAAACAGGC
TTGACGACAA ATAATCAAGG GGAAATTGTT GCAGAGCACT TAGCCCCCAGG AAAATATCGC
TTTGTAGAAA CCAAAGCGCC AACAGGCTAT TTATTAAATA CCACGCCAGT CCCATTTGAA
ATTGCTGAGA AAAATGCTGG TAAACCAGCG GTCGTGGTTG CTAGTGACAA CTTTGTGAGT
TACAAAGGGG CTTTCCAAAT CGTGAAAACG AATAGCGCAG ACCAACCATT AGCAGGTGCT
GTTTTTGAAT TATATGATCA CAATAAACAA TCATTAGGGA TTACAGCAAC GAGTGGCAAA
GATGGCAAAA TTATCTTTAG AGACTTGGCC CCAGGTACCT ATTATTACAA AGAAATCAAA
GCACCAAAAT TACCAGATGG CGCAGATTAT ATTATTTATC CTGAATTAGT AAAAGTAGAA
ATTCGTGGTG ATTTCAAAGG TGATCCGGAG ATTTTCCAAT TAGGGGCCTT CGCCAATTTC
AAAGGACGCG CCGTCTTTAA GAAAATTGAT GCCAATGCGA ACCCACTTCC AGGAACGATT
TTTAAATTGT ATCGAATCGA AAACGGGGAA AAAATCTTTG AAAGAGAAGT AACTGCTGAA
AAAGATGGTT CATTGGCTAT GGAGGATTTA GGTGCTGGTA GCTATGAATT AGATGAACTG
GATGCAACGG ATGGCTATAT GCTCAATAAA CAACCCATTT ATTTTGTAGT GAAGAAGAAT
TCAAATGATA AACAACCACT AGATGAGTTA GAGTTTGTAA ATTATCAAGC AGAAGTAATG
GGACGTAAAG TCAACGAGCA AGGTCAAACC TTAGCGGGTG CAGTTTTTGC AATTTACAAT
GCCGATGAGC AGAATCAGCC CCAAGGTTCA CCGATAACAT TCTTGAATCG TGCAGGAGAA
```

TABLE 1-continued

Nucleotide and Amino Acid Seqeuences of E. faecalis Genes.

```
AAAGTTTCTG AAATAACAAC GGATAAGACT GGCGAAATTT ACGCTAAAGG GCTAAATGAA
GGGCATTACG TTTTAGTGGA AACGAAAGCA CCAACAGGCT ATCTGTTAGA CACAACGCTA
CATCCATTTG ATGTAACCGC CCAATTAGGA AAAGAGCAGC CAATTGCTTT AGGCGATCTT
ATCAATTATC AAGGAACTGC TCAATTAACC AAAGAAAACG AAACAGGTGA AGCATTGGCA
GGTGCGGTGT TTAAGGTCAT TGATGAAACA GGGCAAACCG TAGATGGACA AACCAATCTG
ATGTCTGACA AGCAAGGCAA AGTCATTGCG AAAAACTTAG CACCGGGAAC GTATCGTTTT
GTGGAGACAC AAGCGCCAAC TAGCTATCTT CTTAATGAAA CGCCAAGCGC AAGCTTTACG
ATTGCCAAAG ACAACCAAGG CAAACCAGCC ACTGTGGTAC TTAAAGCACC TTTTATTAAT
TACCAAGGTG CTGCCAAGCT GGTGAAAATT GATCAGCAAA AGAATGCCTT AGCAGGTGCT
GAATTTAAAG TGACAGATGC AGAGACAGGG CAAACTGTCG CTCGTTCATT ACGTTCTGAC
AACCAAGGGT TAGTTCAAGT GAACCACTTA CAACCAGGAA AATATACCTT TGTGGAAACA
AAAGCACCGG ATGGTTACCA ACTGTCTAAG CAAGCTGTCG CATTCACTAT TGCGGCAACA
GCGAAAGCAC AACCTGAACT CGTGAATGCG GGCACGTTTG TTAACGAGAA ACAACCTGTA
TCCAAAAAAA CAAAACCAAA TCAGCCAACA ACGAAACAAG CAGCTAGAGA GACAGGTTGG
CTTGGTTTAC CGAAAACCAA CACACAAGTC AATTACTTCT TTGTCTTTAT CGGCCTCATG
TTGGTCGGTT TGGCAAGTTG GCTCTTCTAT AAAAAGAGCA AGAAATAA

EF124-2 (SEQ ID NO:462)
MRKNGPMV NRWLYGLMCL LLVLNYGTPL MALAEEVNSD
GQLTLGEVKQ TSQQEMTLAL QGKAQPVTQE VVVHYSANVS IKAAHWAAPN NTRKIQVDDQ
KKQIQIELNQ QALADTLVLT LNPTATEDVT FSYGQQQRAL TLKTGTDPTE STAITSSPAA
SANEGSTEEA STNSSVPRSS EETVASTTKA IESKTSTETT VKPRVAGPTD ISDYFTGDET
TIIDNFEDPI YLNPDGTPAT PPYKEDVTIH WNFNWSIPED VREQMKAGDY FEFQLPGNLK
PNKPGSGDLV DAEGNVYGTY TISEDGTVRF TFNERITSES DIHGDFSLDT HLNDSDGRGP
GDWVIDIPTQ EDLPPVVIPI VPDTEQQIDK QGHFDRTPNP SAITWTVDIN QAMKDQTNPT
VTETWPTGNT FKSVKVYELV MNLDGTIKEV GRELSPDEYT VDKNGNVTIK GDTNKAYRLE
YQTTIDEAVI PDGGGDVPFK NHATLTSDNN PNGLDAEATV TATYGKMLDK RNIDYDEANQ
EFTWEINYNY GEQTIPKDQA VITDTMGDNL TFEPDSLHLY SVTFDDKGNE VVGAELVEGK
DYKVVINGDG SFAIDFLHDV TGAVKIDYKT KVDGIVEGDV AVNNRVDVGT GQHSEDDGTA
SQQNIIKNTG AVDYQNSTIG WTLAVNQNNY LMENAVITDT YEPVPGLTMV PNSLVVKDTT
TGAQLTLGKD FMVEITRNAD GETGFKVSFI GAYAKTSDAF HITYTTFFDV TELDANNPAL
DHYRNTAAID WTDEAGNNHH SEDSKPFKPL PAFDLNAQKS GVYNAVTKEI TWTIAVNLSN
NRLVDAFLTD PILTNQTYLA GSLKVYEGNT KPDGSVEKVK PTQPLTDITM EEPSEKNQNT
WRVDFPNDSR TYVIEFKTSV DEKVIEGSAS YDNTASYTNQ GSSRDVTGKV SIQHGGESVK
KGGEYHKDDP DHVYWHVMIN GAQSVLDDVV ITDTPSPNQV LDPESLVIYG TNVTEDGTIT
PDKSVILEEG KDYTLEVTTD NETGQQKIVV KMAHIEAPYY MEYRSLVTSS AAGSTDTVSN
QVSITGNGSE VVHGDDNGDV VVDIDHSGGH ATGTKGKIQL KKTAMDETTI LAGAHFQIWD
QAKTQVLREG TVDATGVITF GGLPQGQYIL VETKAPEGYT VSDELAKGRV ITIDEETSAE
GAQPTIIKND VNKVFLEKMD EKGKKLVNAR FKLEHAVTTP FTHWEEVPLA PDRTNANGQL
EVDSLKPGLY QFTEIEAPTG YLLDTTPKRF IVTQNTSGQI RDVHVKMLNY QGSAELIKKD
QAGNPLAGAE FSVLDTTGQA VREHLVSDAN GKVTVTDLAP GKYQFVETKA PAGYLLNTEP
SAFTIAASDR GKPATVIATA NFVNYQGTAK LIKKDVNGHL LSGATFKVLD AKGETIQTGL
TTNNQGEIVA EHLAPGKYRF VETKAPTGYL LNTTPVPFEI AEKNAGKPAV VVASDNFVSY
KGAFQIVKTN SADQPLAGAV FELYDHNKQS LGITATSGKD GKIIFRDLAP GTYYYKEIKA
PKLPDGADYI IYPELVKVEI RGDFKGDPEI FQLGAFANFK GRAVFKKIDA NANPLPGTIF
KLYRIENGEK IFEREVTAEK DGSLAMEDLG AGSYELDELD ATDGYIVNKQ PIYFVVKKNS
NDKQPLDELE FVNYQAEVMG RKVNEQGQTL AGAVFAIYNA DEQNQPQGSP ITFLNRAGEK
VSEITTDKTG EIYAKGLNEG HYVLVETKAP TGYLLDTTLH PFDVTAQLGK EQPIALGDLI
NYQGTAQLTK ENETGEALAG AVFKVIDETG QTVDGQTNLM SDKQGKVIAK NLAPGTYRFV
ETQAPTSYLL NETPSASFTI AKDNQGKPAT VVLKAPFINY QGAAKLVKID QQKNALAGAE
FKVTDAETGQ TVARSLRSDN QGLVQVNHLQ PGKYTFVETK APDGYQLSKQ AVAFTIAATA
KDKPELVNAG TFVNEKQPVS KKTKPNQPTT KQAARETGWL GLPKTNTQVN YFFVFIGLML
VGLASWLFYK KSKK

EF124-3 (SEQ ID NO:463)
TGCCTTCCACATAACTTATACTACCTTTTTGACG GATCCAATTT TAACCAATCA AACCTATTTG
GCTGGGAGCT TGAAAGTCTA TGAAGGCAAT ACAAAGCCAG ATGGTTCGGT TGAAAAAGTG
AAACCAACGC AACCGTTGAC GGATATCACA ATGGAAGAAC AAGCGAGAA AAACCAAAAT
ACTTGGCGTG TTGATTTTCC TAATGATAGT CGTACGTATG TGATTGAATT TAAGACGTCT
GTTGATGAAA AAGTTATCGA AGGTTCGGCT AGTTATGACA ATACCGCATC TTATACAAAC
CAAGGTTCTT CACGTGATGT GACAGGAAAA GTTTCTATTC AACATGGTGG CGAATCAGTG
AAAAAAGGTG GCGAATACCA CAAAGATGAT CCAGATCATG TGTACTGGCA TGTAATGATC
AATGGCGCCC AATCGGTTTT AGACGATGTG GTTATTACTG ATACACCCTC ACCAAACCAA
GTGCTAGATC CCGAGTCATT GGTGATTTAC GGTACCAACG TAACAGAAGA CGGAACTATT
ACGCCAGATA AATCTGTTAT TTTAGAAGAA GGAAAAGATT ACACACTGGA AGTTACCACC
GATAATGAAA CAGGACAACA AAAAATTGTC GTTAAAATGG CCCATATTGA AGCACCTTAT
TATATGGAAT ATCGTAGTTT AGTGACTTCT TCAGCGGCGG GGAGTACAGA CACGGTATCC
AACCAAGTGT CAATTACTGG AAATGGTTCA GAAGTCGTTC ATGGGGATGA CAATGGCGAT
GTGGTCGTTG ACATTGATCA CAGTGGCGGG CATGCCACAG GGACTAAAGG CAAAATTCAG
CTGAAGAAAA CAGCCATGGA TGAGACGACT ATTTTAGCAG GCGCCCATTT CCAAATTTGG
GACCAAGCTA AAACACAAGT CCTACGTGAA GGTACAGTAG ATGCCACCGG GGTTATCACA
TTTGGTGGGT TGCCACAAGG GCAATACATT TTGGTGGAGA CAAAAGCACC AGAAGGCTAT
ACAGTTTCGG ACGAATTAGC TAAAGGCCGA GTCATTACTA TTGATGAAGA AACTTCAGCC
GAAGGAGCAC AACCAACCAT TATTAAAAAC GATGTCAATA AAGTATTTTT AGAAAAAATG
GATGAGAAGG GTAAAAAGTT AGTCAATGCT CGCTTTAAAT TAGAGCATGC CGTAACCACG
CCGTTTACTC ATTGGGAAGA AGTTCCCCTT GCGCCGGATC GAACCAACGC GAATGGCCAG
TTAGAGGTGG ATAGTTTAAA ACCAGGGCTT TATCAGTTCA CAGAAATCGA AGCACCGACA
```

TABLE 1-continued

Nucleotide and Amino Acid Seqeuences of E. faecalis Genes.

```
GGCTATCTTT TAGACACGAC CCCCAAACGA TTCATCGTGA CACAAAATAC GAGCGGACAA
ATTCGTGATG TTCATGTCAA AATGCTTAAT TACCAAGGTT CTGCTGAACT AATTAAAAAA
GACCAAGCAG GCAATCCATT AGCAGGTGCT GAATTTTCAG TCCTTGACAC CACAGGACAA
GCAGTTCGAG AACACTTAGT TTCGGATGCA AACGGAAAAG TCACAGTGAC GGATTTAGCC
CCAGGAAAAT ATCAATTTGT GGAAACCAAA GCGCCAGCAG GGTACCTTTT AAACACTGAA
CCAAGTGCTT TCACGATTGC AGCAAGCGAT CGGGGCAAAC CAGCAACAGT TATAGCAACG
GCTAACTTTG TTAACTATCA AGGCACGGCT AAATTAATCA AAAAAGATGT GAATGGACAC
TTATTAAGTG GTGCGACATT TAAAGTGCTT GATGCGAAGG GAGAAACGAT TCAAACAGGC
TTGACGACAA ATAATCAAGG G

EF124-4 (SEQ ID NO:464)
AF HITYTTFFDV TELDANNPAL
DHYRNTAAID WTDEAGNNHH SEDSKPFKPL PAFDLNAQKS GVYNAVTKEI TWTIAVNLSN
NRLVDAFLTD PILTNQTYLA GSLKVYEGNT KPDGSVEKVK PTQPLTDITM EEPSEKNQNT
WRVDFPNDSR TYVIEFKTSV DEKVIEGSAS YDNTASYTNQ GSSRDVTGKV SIQHGGESVK
KGGEYHKDDP DHVYWHVMIN GAQSVLDDVV ITDTPSPNQV LDPESLVIYG TNVTEDGTIT
PDKSVILEEG KDYTLEVTTD NETGQQKIVV KMAHIEAPYY MEYRSLVTSS AAGSTDTVSN
QVSITGNGSE VVHGDDNGDV VVDIDHSGGH ATGTKGKIQL KKTAMDETTI LAGAHFQIWD
QAKTQVLREG TVDATGVITF GGLPQGQYIL VETKAPEGYT VSDELAKGRV ITIDEETSAE
GAQPTIIKND VNKVFLEKMD EKGKKLVNAR FKLEHAVTTP FTHWEEVPLA PDRTNANGQL
EVDSLKPGLY QFTEIEAPTG YLLDTTPKRF IVTQNTSGQI RDVHVKMLNY QGSAELIKKD
QAGNPLAGAE FSVLDTTGQA VREHLVSDAN GKVTVTDLAP GKYQFVETKA PAGYLLNTEP
SAFTIAASDR GKPATVIATA NFVNYQGTAK LIKKDVNGHL LSGATFKVLD AKGETIQTGL
TTNNQG

EF125-1 (SEQ ID NO:465)
TAAAATAAAA AATTGGTACG AAGTGAACGT TCTCTTCTAT GTGTCGTTAG TAGAGGAAGG
ATGAAAGAAA TGAGAAAGAA TGGTCCAATG GTAAACCGTT GGCTCTACGG GTTGATGTGT
TTGTTACTTG TTCTAAATTA TGGCACACCA CTCATGGCTT TGGCGGAAGA GGTTAACAGC
GATGGCCAGT TAACGTTAGG AGAAGTGAAG CAAACCAGCC AGCAAGAAAT GACCTTAGCG
CTTCAAGGAA AAGCACAACC AGTAACACAA GAGGTTGTAG TGCATTATAG TGCCAATGTG
TCAATCAAAG CTGCACATTG GGCAGCGCCC AATAATACGC GCAAGATTCA AGTGGATGAC
CAGAAGAAAC AGATTCAAAT TGAATTGAAT CAGCAAGCGT TAGCAGATAC GTTAGTCTTA
ACGTTGAACC CTACAGCTAC AGAAGATGTG ACGTTTTCTT ATGGACAACA GCAACGAGCG
TTGACGTTAA AGACTGGTAC TGATCCGACA GAATCAACGG CAATCACGAG TTCGCCAGCC
GCATCAGCGA ATGAAGGTTC AACAGAAGAA GCATCTACAA ACTCCTCTGT TCCTCGTTCG
TCCGAAGAAA CTGTCGCCAG CACGACAAAA GCGATAGAAA GTAAAACAAC TGAATCGACG
ACTGTCAAAC CGCGCGTAGC AGGACCAACA GATATCAGTG ATTATTTTAC AGGTGATGAA
ACAACGATTA TCGATAATTT TGAAGATCCG ATTTATTTAA ATCCTGATGG AACACCAGCA
ACACCGCCGT ATAAAGAAGA TGTGACCATT CATTGGAACT TTAACTGGTC GATTCCAGAA
GATGTGCGAG AACAAATGAA AGCAGGCGAT TACTTCGAGT TTCAATTACC TGGCAATTTG
AAACCTAATA AACCAGGTTC AGGTGATTTA GTTGATGCAG AAGGCAATGT CTATGGAACC
TACACAATTA GTGAAGATGG TACGGTTCGT TTTACCTTTA ATGAGCGAAT CACGTCTGAA
AGTGACATTC ACGGGGACTT TTCTTTAGAT ACTCATTTGA ATGATTCAGA TGGGCGGGGC
CCAGGAGATT GGGTGATTGA TATTCCTACA CAAGAAGATT TGCCGCCTGT AGTGATTCCA
ATTGTCCCAG ATACCGAACA ACAAATTGAT AAACAAGGCC ATTTTGATCG AACGCCCAAT
CCTAGTGCGA TTACTTGGAC GGTAGATATC AATCAAGCGA TGAAAGATCA AACAAATCCA
ACTGTGACGG AAACATGGCC AACAGGGAAT ACCTTTAAGT CCGTGAAAGT CTATGAGTTA
GTGATGAATC TTGATGGAAC AATTAAAGAA GTGGGTCGCG AACTTAGTCC AGATGAATAT
ACCGTTGATA AAAAATGGCAA TGTGACGATT AAAGGTGACA CCAACAAAGC GTATCGTCTT
GAGTACCAAA CGACGATTGA CGAGGCGGTT ATTCCAGATG GCGGCGGCGA TGTGCCTTTA
AAAAATCACG CGACGTTAAC AAGTGATAAT AATCCAAATG GGTTAGATGC TGAAGCAACT
GTTACCGCCA CATATGGCAA AATGTTAGAC AAGCGCAATA TAGATTACGA CGAAGCCAAT
CCAGAATTCA CTTGGGAAAT TAACTACAAC TATGGTGAAC AAACCATTCC AAAAGACCAA
GCAGTCATTA CAGACACAAT GGGGGATAAT TTAACGTTTG AACCAGATTC TTTACATTTA
TATTCAGTGA CATTTGATGA CAAAGGAAAT GAAGTCGTTG GAGCAGAACT TGTGGAAGGA
AAAGATTACA AAGTGGTAAT CAACGGAGAC GGTTCCTTTG CAATTGACTT TTTACATGAT
GTGACTGGCG CAGTCAAGAT TGATTATAAA ACCAAAGTTG ATGGAATTGT CGAAGGCGAT
GTTGCCGTGA ATAATCGTGT GGATGTTGGC ACTGGTCAGC ATTCAGAAGA TGATGGCACA
GCCAGTCAAC AAAAATATTAT TAAAAACACT GGTGCAGTTG ATTATCAAAA TTCAACGATT
GGTTGGACGT TAGCTGTGAA TCAAAATAAT TATTTGATGG AAAATGCCGT GATTACGGAT
ACGTACGAAC CAGTTCCTGG CTTAACTATG GTACCCAATT CGTTGGTTGT CAAAGATACA
ACCACTGGTG CTCAGTTGAC GTTAGGCAAG GATTTCGTGG TAGAAATAAC TCGTAATCGA
GATGGTGAAA CAGGCTTTAA GGTAAGTTTT ATAGGGCGT ATGCCAAAAC AAGTGATGCC
TTCCACATAA CTTATACTAC CTTTTTCGAT GTTACCGAGT TAGACGCTAA CAATCCTGCG
TTGGACCATT ATCGAAATAC CGCTGCCATT GATTGGACGG ATGAAGCAGG AAACAATCAT
CATTCAGAAG ATAGTAAACC GTTTAAACCT TTACCTGCTT TTGATTTAAA TGCGCAAAAA
AGCGGTGTTT ACAATGCCGT CACCAAAGAA ATCACTTGGA CGATTGCGGT TAATTTAAGT
AATAATCGTT TAGTCGACGC CTTTTTGACG GATCCAATTT TAACCAATCA AACCTATTTG
GCTGGGAGCT TGAAAGTCTA TGAAGGCAAT ACAAAGCCAG ATGGTTCGGT TGAAAAAGTG
AAACCAACGC AACCGTTGAC GGATATCACA ATGGAAGAAC CAAGCGAGAA AAACCAAAAT
ACTTGGCGTG TTGATTTTCC TAATGATAGT CGTACGTATG TGATTGAATT TAAGACGTCT
GTTGATGAAA AAGTTATCGA AGGTTCGGCT AGTTATGACA ATACCGCATC TTATACAAAC
CAAGGTTCTT CACGTGATGT GACAGGAAAA GTTTCTATTC AACATGGTGG CGAATCAGTG
AAAAAAGGTG GCGAATACCA CAAAGATGAT CCAGATCATG TGTACTGGCA TGTAATGATC
AATGGCGCCC AATCGGTTTT AGACGATGTG GTTATTACTG ATACACCCTC ACCAAACCAA
GTGCTAGATC CCGAGTCATT GGTGATTTAC GGTACCAACG TAACAGAAGA CGGAACTATT
```

TABLE 1-continued

Nucleotide and Amino Acid Seqeuences of E. faecalis Genes.

```
ACGCCAGATA AATCTGTTAT TTTAGAAGAA GGAAAAGATT ACACACTGGA AGTTACCACC
GATAATGAAA CAGGACAACA AAAAATTGTC GTTAAAATGG CCCATATTGA AGCACCTTAT
TATATGGAAT ATCGTAGTTT AGTGACTTCT TCAGCGGCGG GGAGTACAGA CACGGTATCC
AACCAAGTGT CAATTACTGG AAATGGTTCA GAAGTCGTTC ATGGGGATGA CAATGGCGAT
GTGGTCGTTG ACATTGATCA CAGTGGCGGG CATGCCACGG GGACTAAAGG CAAAATTCAG
CTGAAGAAAA CAGCCATGGA TGAGACGACT ATTTTAGCAG GCGCCCATTT CCAAATTTGG
GACCAAGCTA AAACACAAGT CCTACGTGAA GGTACAGTAG ATGCCACCGG GGTTATCACA
TTTGGTGGGT TGCCACAAGG GCAATACATT TTGGTGGAGA CAAAAGCACC AGAAGGCTAT
ACAGTTTCGG ACGAATTAGC TAAAGGCCGA GTCATTACTA TTGATGAAGA AACTTCAGCC
GAAGGAGCAC AACCAACCAT TATTAAAAAC GATGTCAATA AAGTATTTTT AGAAAAAATG
GATGAGAAGG GTAAAAAGTT AGTCAATGCT CGCTTTAAAT TAGAGCATGC CGTAACCACG
CCGTTTACTC ATTGGGAAGA AGTTCCCCTT GCGCCGGATC GAACCAACGC GAATGGCCAG
TTAGAGGTGG ATAGTTTAAA ACCAGGGCTT TATCAGTTCA CAGAAATCGA AGCACCGACA
GGCTATCTTT TAGACACGAC CCCCAAACGA TTCATCGTGA CACAAAATAC GAGCGGACAA
ATTCGTGATG TTCATGTCAA AATGCTTAAT TACCAAGGTT CTGCTGAACT AATTAAAAAA
GACCAAGCAG GCAATCCATT AGCAGGTGCT GAATTTTCAG TCCTTGACAC CACAGGACAA
GCAGTTCGAG AACACTTAGT TTCGGATGCA AACGGAAAAG TCACAGTGAC GGATTTAGCC
CCAGGAAAAT ATCAATTTGT GGAAACCAAA GCGCCAGCAG GGTACCTTTT AAACACTGAA
CCAAGTGCTT TCACGATTGC AGCAAGCGAT CGGGGCAAAC CAGCAACAGT TATAGCAACG
GCTAACTTTG TTAACTATCA AGGCACGGCT AAATTAATCA AAAAAGATGT GAATGGACAC
TTATTAAGTG GTGCGACATT TAAAGTGCTT GATGCGAAGG GAGAAACGAT TCAAACAGGC
TTGACGACAA ATAATCAAGG GGAAATTGTT GCAGAGCACT TAGCCCCAGG AAAAATATCGC
TTTGTAGAAA CCAAAGCGCC AACAGGCTAT TTATTAAATA CCACGCCAGT CCCATTTGAA
ATTGCTGAGA AAAATGCTGG TAAACCAGCG GTCGTGGTTG CTAGTGACAA CTTTGTGAGT
TACAAAGGGG CTTTCCAAAT CGTGAAAACG AATAGCGCAG ACCAACCATT AGCAGGTGCT
GTTTTTGAAT TATATGATCA CAATAAACAA TCATTAGGGA TTACAGCAAC GAGTGGCAAA
GATGGCAAAA TTATCTTTAG AGACTTGGCG CCAGGTACCT ATTATTACAA AGAAATCAAA
GCACCAAAAT TACCAGATGG CGCAGATTAT ATTATTTATC CTGAATTAGT AAAAGTAGAA
ATTCGTGGTG ATTTCAAAGG TGATCCGGAG ATTTTCCAAT TAGGGGCCTT CGCCAATTTC
AAAGGACGCG CCGTCTTTAA GAAAATTGAT GCCAATGCGA ACCCACTTCC AGGAACGATT
TTTAAATTGT ATCGAATCGA AAACGGGAA AAAATCTTTG AAAGAGAAGT AACTGCTGAA
AAAGATGGTT CATTGGCTAT GGAGGATTTA GGTGCTGGTA GCTATGAATT AGATGAACTG
GATGCAACGG ATGGCTATAT CGTCAATAAA CAACCCATTT ATTTTGTAGT GAAGAAGAAT
TCAAATGATA AACAACCACT AGATGAGTTA GAGTTTGTAA ATTATCAAGC AGAAGTAATG
GGACGTAAAG TCAACGAGCA AGGTCAAACC TTAGCGGGTG CAGTTTTTGC AATTTACAAT
GCCGATGAGC AGAATCAGCC CCAAGGTTCA CCGATAACAT TCTTGAATCG TGCAGGAGAA
AAAGTTTCTG AAATAACAAC GGATAAGACT GGCGAAATTT ACGCTAAAGG GCTAAATGAA
GGGCATTACG TTTTAGTGGA AACGAAAGCA CCAACAGCCT ATCTGTTAGA CACAACGCTA
CATCCATTTG ATGTAACCGC CCAATTAGGA AAAGAGCAGC CAATTGCTTT AGGCGATCTT
ATCAATTATC AAGGAACTGC TCAATTAACC AAAGAAAACG AAACAGGTGA AGCATTGGCA
GGTGCGGTGT TTAAGGTCAT TGATGAAACA GGGCAAACCG TAGATGGACA AACCAATCTG
ATGTCTGACA AGCAAGGCAA AGTCATTGCG AAAAACTTAG CACCGGGAAC GTATCGTTTT
GTGGAGACAC AAGCGCCAAC TAGCTATCTT CTTAATGAAA CGCCAAGCGC AAGCTTTACG
ATTGCCAAAG ACAACCAAGG CAAACCAGCC ACTGTGGTAC TTAAAGCACC TTTTATTAAT
TACCAAGGTG CTGCCAAGCT GGTGAAAATT GATCAGCAAA AGAATGCCTT AGCAGGTGCT
GAATTTAAAG TGACAGATGC AGAGACAGGG CAAACTGTCG CTCGTTCATT ACGTTCTGAC
AACCAAGGGT TAGTTCAAGT GAACCACTTA CAACCAGGAA AATATACCTT TGTGGAAACA
AAAGCACCGG ATGGTTACCA ACTGTCTAAG CAAGCTGTCG CATTCACTAT TGCGGCAACA
GCGAAAGACA AACCTGAACT CGTGAATGCG GCACGTTTG TTAACGAGAA ACAACCTGTA
TCCAAAAAAA CAAAACCAAA TCAGCCAACA ACGAAACAAG CAGCTAGAGA GACAGGTTGG
CTTGGTTTAC CGAAAACCAA CACACAAGTC AATTACTTCT TTGTCTTTAT CGGCCTCATG
TTGGTCGGTT TGGCAAGTTG GCTCTTCTAT AAAAAAGAGCA AGAAATAA
```

EF125-2 (SEQ ID NO:466)  
MRKNGPMV NRWLYGLMCL LLVLNYGTPL MALAEEVNSD  
GQLTLGEVKQ TSQQEMTLAL QGKAQPVTQE VVVHYSANVS IKAAHWAAPN NTRKIQVDDQ  
KKQIQIELNQ QALADTLVLT LNPTATEDVT FSYGQQQRAL TLKTGTDPTE STAITSSPAA  
SANEGSTEEA STNSSVPRSS EETVASTTKA IESKTTESTT VKPRVAGPTD ISDYFTGDET  
TIIDNFEDPI YLNPDGTPAT PPYKEDVTIH WNFNWSIGED VREQMKAGDY FEFQLPGNLK  
PNKPGSGDLV DAEGNVYGTY TISEDGTVRF TFNERITSES DIHGDFSLDT HLNDSDGRGP  
GDWVIDIPTQ EDLPPVVIPI VPDTEQQIDK QGHFDRTPNP SAITWTVDIN QAMKDQTNPT  
VTETWPTGNT FKSVKVYELV MNLDGTIKEV GRELSPDEYT VDKNGNVTIK GDTNKAYRLE  
YQTTIDEAVI PDGGGDVPFK NHATLTSDNN PNGLDAEATA TATYGKMLDK RNIDYDEANQ  
EFTWEINYNY GEQTIPKDQA VITDTMGDNL TFEPDSLHLY SVTFDDKGNE VVGAELVEGK  
DYKVVINGDG SFAIDFLHDV TGAVKIDYKT KVDGIVEGDV AVNNRVDVGT GQHSEDDGTA  
SQQNIIKNTG AVDYQNSTIG WTLAVNQNNY LMENAVITDT YEPVPGLTMV PNSLVVKDTT  
TGAQLTLGKD FMVEITRNAD GETGFKVSFI GAYAKTSDAF HITYTTFFDV TELDANNPAL  
DHYRNTAAID WTDEAGNNHH SEDSKPFKPL PAFDLNAQKS GVYNAVTKEI TWTIAVNLSN  
NRLVDAFLTD PILTNQTYLA GSLKVYEGNT KPDGSVEKVK PTQPLTDITM EEPSEKNQNT  
WRVDFPNDSR TYVIEFKTSV DEKVIEGSAS YDNTASYTNQ GSSRDVTGKV SIQHGGESVK  
KGGEYHKDDP DHVYWHVMIN GAQSVLDDVV ITDTSPNQV LDPESLVIYG TNVTEDGTIT  
PDKSVILEEG KDYTLEVTTD NETGQQKIVV KMAHIEAPYY MEYRSLVTSS AAGSTDTVSN  
QVSITGNGSE VVHGDDNGDV VVDIDHSGGH ATGTKGKIQL KKTAMDETTI LAGAHFQIWD  
QAKTQVLREG TVDATGVITF GGLPQGQYIL VETKAPEGYT VSDELAKGRV ITIDEETSAE  
GAQPTIIKND VNKVFLEKMD EKGKKLVNAR FKLEHAVTTP FTHWEEVPLA PDRTNANGQL  
EVDSLKPGLY QFTEIEAPTG YLLDTTPKRF IVTQNTSGQI RDVHVKMLNY QGSAELIKKD  
QAGNPLAGAE FSVLDTTGQA VREHLVSDAN GKVTVTDLAP GKYQFVETKA PAGYLLNTEP

TABLE 1-continued

Nucleotide and Amino Acid Seqeuences of *E. faecalis* Genes.

SAFTIAASDR GKPATVIATA NFVNYQGTAK LIKKDVNGHL LSGATFKVLD AKGETIQTGL
TTNNQGEIVA EHLAPGKYRF VETKAPTGYL LNTTPVPFEI AEKNAGKPAV VVASDNFVSY
KGAFQIVKTN SADQPLAGAV FELYDHNKQS LGITATSGKD GKIIFRDLAP GTYYYKEIKA
PKLPDGADYI IYPELVKVEI RGDFKGDPEI FQLGAFANFK GRAVFKKIDA NANPLPGTIF
KLYRIENGEK IFEREVTAEK DGSLAMEDLG AGSYELDELD ATDGYIVNKQ PIYFVVKKNS
NDKQPLDELE FVNYQAEVMG RKVNEQGQTL AGAVFAIYNA DEQNPQGSP ITFLNRAGEK
VSEITTDKTG EIYAKGLNEG HYVLVETKAP TGYLLDTTLH PFDVTAQLGK EQPIALGDLI
NYQGTAQLTK ENETGEALAG AVFKVIDETG QTVDGQTNLM SDKQGKVIAK NLAPGTYRFV
ETQAPTSYLL NETPSASFTI AKDNQGKPAT VVLKAPFINY QGAAKLVKID QQKNALAGAE
FKVTDAETGQ TVARSLRSDN QGLVQVNHLQ PGKYTFVETK APDGYQLSKQ AVAFTIAATA
KDKPELVNAG TFVNEKQPVS KKTKPNQPTT KQAARETGWL GLPKTNTQVN YFFVFIGLML
VGLASWLFYK KSKK

EF125-3 (SEQ ID NO:467)
TAACTTTG TTAACTATCA AGGCACGGCT AAATTAATCA AAAAGATGT GAATGGACAC
TTATTAAGTG GTGCGACATT TAAAGTGCTT GATGCGAAGG GAGAAACGAT TCAAACAGGC
TTGACGACAA ATAATCAAGG GGAAATTGTT GCAGAGCACT TAGCCCCAGG AAAATATCGC
TTTGTAGAAA CCAAAGCGCC AACAGGCTAT TTATTAAATA CCACGCCAGT CCCATTTGAA
ATTGCTGAGA AAAATGCTGG TAAACCAGCG GTCGTGGTTG CTAGTGACCA CTTTGTGAGT
TACAAAGGGG CTTTCCAAAT CGTGAAAACG AATAGCGCAG ACCAACCATT AGCAGGTGCT
GTTTTTGAAT TATATGATCA CAATAAACAA TCATTAGGGA TTACAGCAAC GAGTGGCAAA
GATGGCAAAA TTATCTTTAG AGACTTGGCG CCAGGTACCT ATTATTACAA AGAAATCAAA
GCACCAAAAT TACCAGATGG CGCAGATTAT ATTATTTATC CTGAATTAGT AAAAGTAGAA
ATTCGTGGTG ATTTCAAAGG TGATCCGGAG ATTTTCCAAT TAGGGCCTT CGCCAATTTC
AAAGGACGCG CCGTCTTTAA GAAAATTGAT GCCAATGCGA ACCCACTTCC AGGAACGATT
TTTAAATTGT ATCGAATCGA AAACGGGGAA AAATCTTTTG AAAGAGAAGT AACTGCTGAA
AAAGATGGTT CATTGGCTAT GGAGGATTTA GGTGCTGGTA GCTATGAATT AGATGAACTG
GATGCAACGG ATGGCTATAT CGTCAATAAA CAACCCATTT ATTTTGTAGT GAAGAAGAAT
TCAAATGATA ACAACCACT AGATGAGTTA GAGTTTGTAA ATTATCAAGC AGAAGTAATG
GGACGTAAAG TCAACGAGCA AGGTCAAACC TTAGCGGGTG CAGTTTTTGC AATTTACAAT
GCCGATGAGC AGAATCAGCC CCAAGGTTCA CCGATAACAT TCTTGAATCG TGCAGGAGAA
AAAGTTTCTG AATAACAAC GGATAAGACT GGCGAAATTT ACGCTAAAGG GCTAAATGAA
GGGCATTACG TTTTAGTGGA AACGAAAGCA CCAACAGGCT ATCTGTTAGA CACAACGCTA
CATCCATTTG ATGTAACCGC CCAATTAGGA AAAGAGCAGC CAATTGCTTT AGGCGATCTT
ATCAATTATC AAGGAACTGC TCAATTAACC AAAGAAAACG AAACAGGTGA AGCATTGGCA
GGTGCGGTGT TTAAGGTCAT TGATGAAACA GGGCAAACCG TAGATGGACA AACCAATCTG
ATGTCTGACA AGCAAGGCAA AGTCATTGCG AAAAACTTAG CACCGGGAAC GTATCGTTTT
GTGGAGACAC AAGCGCCAAC TAGCTATCTT CTTAATGAAA CGCCAAGCGC AAGCTTTACG
ATTGCCAAAG ACAACCAAGG CAAACCAGCC ACTGTGGTAC TTAAAGCACC TTTTATTAAT
TACCAAGGTG CTGCCAAGCT GGTGAAAATT GATCAGCAAA AGAATGCCTT AGCAGGTGCT
GAATTTAAAG TGACAGATGC AGAGACAGGG CAAACTGTCG CTCGTTCATT ACGTTCTGAC
AACCAAGGGT TAGTTCAAGT GAACCACTTA CAACCAGGAA AATATACCTT TGTGGAAACA
AAAGCACCGG ATGGTTACCA ACTGTCTAAG CAAGCTGTCG CATTCACTAT TGCGGCAACA
GCGAAAGACA AACCTGAACT CGTGAATGCG GGCACGTTTG TTAACGAGAA ACAACCTGTA
TCCAAAAAAA CAAAACCAAA TCAGCCAACA ACGAAACAAG CAGCTAGAGA GACAGGTTGG
CTTGGT

EF125-4 (SEQ ID NO:468)
NFVNYQGTAK LIKKDVNGHL LSGATFKVLD AKGETIQTGL
TTNNQGEIVA EHLAPGKYRF VETKAPTGYL LNTTPVPFEI AEKNAGKPAV VVASDNFVSY
KGAFQIVKTN SADQPLAGAV FELYDHNKQS LGITATSGKD GKIIFRDLAP GTYYYKEIKA
PKLPDGADYI IYPELVKVEI RGDFKGDPEI FQLGAFANFK GRAVFKKIDA NANPLPGTIF
KLYRIENGEK IFEREVTAEK DGSLAMEDLG AGSYELDELD ATDGYIVNKQ PIYFVVKKNS
NDKQPLDELE FVNYQAEVMG RKVNEQGQTL AGAVFAIYNA DEQNPQGSP ITFLNRAGEK
VSEITTDKTG EIYAKGLNEG HYVLVETKAP TGYLLDTTLH PFDVTAQLGK EQPIALGDLI
NYQGTAQLTK ENETGEALAG AVFKVIDETG QTVDGQTNLM SDKQGKVIAK NLAPGTYRFV
ETQAPTSYLL NETPSASFTI AKDNQGKPAT VVLKAPFINY QGAAKLVKID QQKNALAGAE
FKVTDAETGQ TVARSLRSDN QGLVQVNHLQ PGKYTFVETK APDGYQLSKQ AVAFTIAATA
KDKPELVNAG TFVNEKQPVS KKTKPNQPTT KQAARETGWLG

EF126-1 (SEQ ID NO:469)
TAGCGAAAGA AATAGGGAG GATTAAAATG TTTAAGAAAG CAACGAAATT ATTATCGACA
ATGGTGATTG TCGCTGGAAC CGTTGTGGGA AATTTCAGTC CCACATTGGC TTTAGCTGAA
GAAGCGGTTA AAGCAGGAGA TACAGAAGGA ATGACCAATA CGGTGAAAGT GAAAGACGAC
AGTCTGGCTG ATTGTAAACG GATATTGGAA GGACAAGCTA CTTTCCCAGT TGAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAA GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC CAAGACATCC TCTTCAAGTC
TCAGTGGAAT ATAGTAATGA CTACCAAGGT GCAGCAGCGA AAGTTTTAGC GTTAAACCAA
GAAATTACTA CCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT

TABLE 1-continued

Nucleotide and Amino Acid Seqeuences of E. faecalis Genes.

```
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAANCAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCACCTGC ACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCATTTACC AATGACTAAT
ACAACAGTAA ATCCACTTTA CATGATCGCA GGTTTAATTG TCCTTATAGT GGCTATTAGC
TTTGGCATAA CAAAAAATAA AAAAAGAAAA AATTAG

EF126-2 (SEQ ID NO:470)
MF KKATKLLSTM VIVAGTVVGN FSPTLALAEE AVKAGDTEGM TNTVKVKDDS
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF126-3 (SEQ ID NO:471)
TGAA
GAAGCGGTTA AAGCAGGAGA TACAGAAGGA ATGACCAATA CGGTGAAAGT GAAAGACGAC
AGTCTGGCTG ATTGTAAACG GATATTGGAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC ACGCTTTAGA TACGTACAAT CAAACACAGG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC CAAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGAT

EF126-4 (SEQ ID NO:472)
EE AVKAGDTEGM TNTVKVKDDS
LADCKRILEG QATFPVQAGE TEPVDLVVVE DASGSFSDNF PHVRQAIDEV VQGLSDQDRV
```

TABLE 1-continued

Nucleotide and Amino Acid Seqeuences of E. faecalis Genes.

MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAID

EF127-1 (SEQ ID NO:473)
TAGCGAAAGA AAATAGGGAG GATTAAAATG TTTAAGAAAG CAACGAAATT ATTATCGACA
ATGGTGATTG TCGCTGGAAC AGTTGTGGGA AATTTCAGTC CCACATTGGC TTTAGCTGAA
GAAGCGGTTA AAGCAGGAGA TACAGAAGGA ATGACCAATA CGGTGAAAGT GAAAGACGAC
AGTCTGGCTG ATTGTAAACG GATATTGGAA GGACAAGCTA CTTTCCCAGT TCAAGCGGGT
GAAACGGAAC CAGTCGATTT AGTAGTTGTT GAAGATGCTA GTGGTAGTTT TTCAGATAAT
TTTCCACATG TAACAGAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC CAAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGCGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AATGGTAAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC AACAAACCA
ACCGTAACAC CACCGCCACT TGATCCAAAT ATTGCTAAAG ACGTAGAAGG ACAAGAACAT
TTAGATTTAA CCAACCGCGA TCAAGAATTT AAATGGAACG TCAAAACGGC TTTCGGTAAC
GAAACAAGCA CTTGGACCCA AGCCAGCATG GTAGATGACA TTAATAAAGT GTTAGACATC
ACTGATGTAA AAGTCACAGA TGAAAATGGT AAAGATGTTA CAGCTAACGG CAAAGTAACA
CAAGAAAATA ACAAAGTAAC TTTTGAAATG AACAACAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCACCTGC ACCAACGCCA
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTTCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCATTTACC AATGACTAAT
ACAACAGTAA ATCCACTTTA CATGATCGCA GGTTTAATTG TCCTTATAGT GGCTATTAGC
TTTGGCATAA CAAAAAATAA AAAAAGAAAA AATTAG

EF127-2 (SEQ ID NO:474)
MF KKATKLLSTM VIVAGTVVGN FSPTLALAEE AVKAGDTEGM TNTVKVKDDS
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSGTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF127-3 (SEQ ID NO:475)

TABLE 1-continued

Nucleotide and Amino Acid Seqeuences of E. faecalis Genes.

```
GAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
GATGTTACAG CTAACGGCAC AGTAACACAA GAAAATAACA AAGTAACTTT TGAAATGAAC
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT
TTAGATTTAA CCAACCGCGA TCAAGAATTT AAATGGAACG TCAAAACAGC TTTCGGTAAC
GAAACAAGCA CTTGGACCCA AGCCAGCATG GTAGATGACA TTAAT

EF127-4 (SEQ ID NO:476)
NQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDIN

EF128-1 (SEQ ID NO:477)
TAGCGAAAGA AAATAGGGAG GATTAAAATG TTTAAGAAAG CAACGAAATT ATTATCGACA
ATGGTGATTG TCGCTGGAAC AGTTGTGGGA AATTTCAGTC CCACATTGGC TTTAGCTGAA
GAAGCGGTTA AAGCAGGAGA TACAGAAGGA ATGACCAATA CGGTGAAAGT GAAAGACGAC
AGTCTGGCTG ATTGTAAACG GATATTGGAA GGACAAGCTA CTTTCCCAGT TCAAGCGGGT
GAAACGGAAC CAGTCGATTT AGTAGTTGTT GAAGATGTCA GTGGTAGTTT TTCAGATAAT
TTTCCACATG TAAGACAAGC GATTGATGAA GTGGTTCAAG GCTTATCTGA TCAAGACCGC
GTGATGCTGG CTTCATATCG CGGCGGAAAA CAATTTATGT TTCCTGATGG AAAGACAAAA
ATTAATTCAG CTGATTATGA TATGAATGTG CGCGTCAATA CGCAATTGAC TTATGATAAA
AGCCAATTTG TCTCTGGTTT TGGAGACGTT CGGACGTATG GTGGTACGCC AACCGCCCCA
GGATTGAAAC TCGCTTTAGA TACGTACAAT CAAACACACG GAGATTTAAC GAATCGAAAA
ACGTATTTCC TATTAGTGAC AGATGGGGTC GCTAATACAC GTTTAGATGG TTACTTGCAT
AAGACCAATA CCAATGATTC AATCAATGAA TATCCAGATC AAGACATCC TCTTCAAGTC
TCAGTGGAAT ATAGTAATGA CTACCAAGGT GCAGCAGCAG AAGTTTTAGC GTTAAACCAA
GAAATTACTA ACCAAGGCTA TGAAATGATT AATGCGTATT GGGAAAGTGT TGAATCTTTA
AGTTCAGTGA ATTCATACTT TGATAAATAT AAAACAGAAG TGGGTCCTTT TGTAAAACAA
GAGTTGCAAC AAGGGTCTAG CACACCAGAA GATTTTATTA CAAGCCAATC TATTGATGAT
TTTACAACCC AATTAAAACA AATTGTCAAA GATCGTCTGG CGCAATCGAC ACCAGCAACA
GCTTCATTAA CGATTGCCAA TCAATTTGAT ATTCAATCTG CGACCGCTAC GGACGATGCT
GGAAATGATG TGCCTGTTCA AATTAACGGA CAAACCATTT CAGCAACTAG TACAGAAGGT
TACGTAGGAA ACATCACGAT TCACTACGAA GTCAAAGAAA ATACAGGGAT TGATGCAGCA
ACCCTTGTAA GTAGTGGGAC AATGAATCAA GGAACAATTG CTAAGGAATT TCCAGAAGCG
ACGATTCCTA AAAATGACAA TGCGCATGCG TGTGACGTGA CGCCAGAAGA TCCAACGATT
ACAAAAGATA TCGAAAATCA AGAACACTTA GATTTAACCA ATCGTGAAGA TAGTTTCGAT
TGGCATGTCA AAACAGCCTT TGGCAACGAA ACCAGTACTT GGACCCAAGC CAGCATGGTG
GATGACATTA ATAAAGTGCT AGATATCATT GATGTGAAAG TCACCGACGA AAATGGTAAA
AAACAAGCAG ACAGCTATGA CTATTTAAGT GGTCATACGT ATACAATGAC TATCACCACT
AAAATTAAAA CTGACGCAAC GGACGAAGAA TTAGCGCCTT ACATTGAACA AGGCGGGATT
CCCAACCAAG CCGACTTAAA CTTTGGCAAT GAAGGTGACG TGTTACATTC CAACAAACCA
ACCGTAACAC CACCGCCAGT TGATCCAAAT ATTGCTAAAG ACGTAGAAGG ACAAGAACAT

EF128-2 (SEQ ID NO:478)
MF KKATKLLSTM VIVAGTVVGN FSPTLALAEE AVKAGDTEGM TNTVKVKDDS
LADCKRILEG QATFPVQAGE TEPVDLVVVE DASGSFSDNF PHVRQAIDEV VQGLSDQDRV
LADCKRILEG QATFPVQAGE TEPVDLVVVE DASGSFSDNF PHVRQAIDEV VQGLSDQDRV
MLASYRGGKQ FMFPDGKTKI NSADYDMNVR VNTQLTYDKS QFVSGFGDVR TYGGTPTAPG
LKLALDTYNQ THGDLTNRKT YFLLVTDGVA NTRLDGYLHK TNTNDSINEY PDPRHPLQVS
VEYSNDYQGA AAEVLALNQE ITNQGYEMIN AYWESVESLS SVNSYFDKYK TEVGPFVKQE
LQQGSSTPED FITSQSIDDF TTQLKQIVKD RLAQSTPATA SLTIANQFDI QSATATDDAG
NDVPVQINGQ TISATSTEGY VGNITIHYEV KENTAIDAAT LVSSGTMNQG TIAKEFPEAT
IPKNDNAHAC DVTPEDPTIT KDIENQEHLD LTNREDSFDW HVKTAFGNET STWTQASMVD
DINKVLDIID VKVTDENGKD VTANGTVTQE NNKVTFEMNK QADSYDYLSG HTYTMTITTK
IKTDATDEEL APYIEQGGIP NQADLNFGNE GDVLHSNKPT VTPPPVDPNI AKDVEGQEHL
DLTNRDQEFK WNVKTAFGNE TSTWTQASMV DDINKVLDIT DVKVTDENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHLDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIHLPMTNT TVNPLYMIAG LIVLIVAISF
GITKNKKRKN

EF128-3 (SEQ ID NO:479)
AGA TGAAAATGGT AAAGATGTTA CAGCTAACGG CAAAGTAACA
CAAGAAAATA ACAAAGTAAC TTTTGAAATG AACAANCAAG CNGACAGCTA TGACTATTTA
AGTGGTCATA CGTACACAAT GACCATTACT ACTAAAATCA AAGCTAGCGC AACGGACGAA
GAATTAGCAC CTTATATTGA ACAAGGTGGC ATTCCCAACC AAGCCGACTT GAACTTTGGC
AACGAAGGTG ACGTGTTGCA TTCCAACAAA CCAACCGTAA CACCACCTGC ACCAACGCCA
```

TABLE 1-continued

Nucleotide and Amino Acid Seqeuences of *E. faecalis* Genes.

```
GAAGATCCAA CGATTACAAA AGATATCGAA GGCCAAGAAC ATTTAGATTT AACCAACCGT
GACCAAGAAT TTAAATGGAA CGTCAAAACA GCTTTCGGTA ACGAAACAAG CACATGGACC
CAAGCCAGCA TGGTGGATGA CATTAATAAA GTGTTAGACA TCACAGACGT GAAAGTTNCT
GANGAAAATG GCAAAGATGT TACAGATAAT GGCATAGTAA CACAAGAAAA TAACAAAGTA
ACTTTTACTA TGAACAAAAA AGATGACAGC TACTCTTACT TAGCTGGTCA TACATACACA
ATGACTATTA CCACTAAAAT TAAAACTGAC GCAACGGATG AAGAATTAGC GCCTTATATT
GAACAAGGCG GGATTCCCAA CCAAGCCGAC TTAAACTTTG GCAACGAAGG TGACGTGTTG
CATTCCAACA AGCCAACCGT AACACCGCCT GCACCAACGC CAGAAGACCC AAAAAAACCT
GAACCTAAAC AACCGCTAAA ACCGAAAAAA CCGTTGACGC CTACAAATCA TCAAGCACCA
ACGAACCCAG TCAATTTTGG AAAATCAGCA AGTAAAGGAA TTCAT

EF128-4 (SEQ ID NO:480)
DENGK DVTANGKVTQ
ENNKVTFEMN XQADSYDYLS GHTYTMTITT KIKASATDEE LAPYIEQGGI PNQADLNFGN
EGDVLHSNKP TVTPPAPTPE DPTITKDIEG QEHDLTNRD QEFKWNVKTA FGNETSTWTQ
ASMVDDINKV LDITDVKVXX ENGKDVTDNG IVTQENNKVT FTMNKKDDSY SYLAGHTYTM
TITTKIKTDA TDEELAPYIE QGGIPNQADL NFGNEGDVLH SNKPTVTPPA PTPEDPKKPE
PKQPLKPKKP LTPTNHQAPT NPVNFGKSAS KGIH

EF129-1 (SEQ ID NO:481)
TGACAAGTGA AGAAACGTCT ATTTGCATCA GTATTACTAT GTTCATTAAC GCTATCAGCA
ATTGCTACCC CAAGCATCGC TTTGGCGGAC AATGTTGATA AAAAAATTGA AGAAAAAAAT
CAAGAAATTT CATCATTAAA AGCAAAACAA GGGGATTTAG CTTCACAAGT ATCTTCTTTA
GAAGCAGAAG TATCTTCAGT ATTTGATGAA AGCATGGCTT TACGTGAACA AAAGCAAACA
CTAAAAGCAA AATCAGAACA ATTACAACAA GAAATTACAA ACTTGAATCA ACGTATTGAA
AAACGTAACG AAGCAATCAA AAATCAAGCA CGTGATGTTC AAGTTAATGG ACAAAGCACA
ACAATGCTAG ATGCAGTTTT AGATGCGGAC TCAGTTGCAG ATGCAATCAG CCGTGTTCAA
GCTGTTTCAA CAATCGTAAG TGCCAACAAC GACTTAATGC AACAACAAAA AGAAGACAAA
CAAGCCGTTG TTGATAAAAA AGCTGAAAAC GAGAAAAAAG TGAAACAACT TGAAGCAACA
GAAGCTGAAT TAGAAACAAA ACGTCAAGAT TTACTTTCTA AACAATCTGA ATTAAACGTA
ATGAAAGCTT CATTAGCATT AGAACAATCA TCAGCTGAAA GTTCTAAAGC TGGCTTAGAA
AAACAAAAAG CAGCTGCTGA AGCAGAGCAA GCACGCTTAG CTGCTGAACA AAAAGCTGCA
GCTGAAAAAG CCAAACAAGC TGCTGCAAAA CCAGCTAAAG CTGAAGTGAA AGCAGAAGCA
CCAGTTGCCT CTTCATCAAC AACAGAAGCA CAAGCACCAG CAAGCTCAAG CTCAGCAACT
GAATCAAGCA CGCAACAAAC AACTGAAACA ACTACACCAA GTACAGATAA TAGTGCAACA
GAAAATACTG GCTCTTCTTC ATCAGAACAA CCAGTACAAC CTACAACACC AAGCGATAAT
GGAAATAATG GTGGCCAAAC TGGTGGTGGA ACAGTTACAC CAACACCAGA ACCAACACCA
GCGCCTTCTG CTGATCCAAC AATCAATGCA TTGAACGTTC TACGTCAATC ATTAGGTTTA
CGTCCAGTAG TATGGGATGC AGGTTTGGCA GCTTCTGCAA CTGCTCGTGC AGCACAAGTT
GAAGCAGGTG GCATTCCAAA TGATCACTGG TCTCGTGGAG ATGAAGTTAT CGCAATTATG
TGGGCGCCAG GTAACTCAGT AATCATGGCG TGGTACAATG AAACAAACAT GGTAACAGCT
TCAGGAAGCG GTCACCGTGA TTGGGAAATT AACCCAGGTA TTACGCGTGT CGGTTTTGGT
TACTCAGGTA GCACAATCGT AGGACACTCA GCCTAA

EF129-2 (SEQ ID NO:482)
VKKRLFASV LLCSLTLSAI ATPSIALADN VDKKIEEKNQ EISSLKAKQG DLASQVSSLE
AEVSSVFDES MALREQKQTL KAKSEQLQQE ITNLNQRIEK RNEAIKNQAR DVQVNGQSTT
MLDAVLDADS VADAISRVQA VSTIVSANND LMQQQKEDKQ AVVDKKAENE KKVKQLEATE
AELETKRQDL LSKQSELNVM KASLALEQSS AESSKAGLEK QKAAAEAEQA RLAAEQKAAA
EKAKQAAAKP AKAEVKAEAP VASSSTTEAQ APASSSSATE SSTQQTTETT TPSTDNSATE
NTGSSSSEQP VQPTTPSDNG NNGGQTGGGT VTPTPEPTPA PSADPTINAL NVLRQSLGLR
PVVWDAGLAA SATARAAQVE AGGIPNDHWS RGDEVIAIMW APGNSVIMAW YNETNMVTAS
GSGHRDWEIN PGITRVGFGY SGSTIVGHSA

EF129-3 (SEQ ID NO:483)
GGAC AATGTTGATA AAAAAATTGA AGAAAAAAAT
CAAGAAATTT CATCATTAAA AGCAAAACAA GGGGATTTAG CTTCACAAGT ATCTTCTTTA
GAAGCAGAAG TATCTTCAGT ATTTGATGAA AGCATGGCTT TACGTGAACA AAAGCAAACA
CTAAAAGCAA AATCAGAACA ATTACAACAA GAAATTACAA ACTTGAATCA ACGTATTGAA
AAACGTAACG AAGCAATCAA AAATCAAGCA CGTGATGTTC AAGTTAATGG ACAAAGCACA
ACAATGCTAG ATGCAGTTTT AGATGCGGAC TCAGTTGCAG ATGCAATCAG CCGTGTTCAA
GCTGTTTCAA CAATCGTAAG TGCCAACAAC GACTTAATGC AACAACAAAA AGAAGACAAA
CAAGCCGTTG TTGATAAAAA AGCTGAAAAC GAGAAAAAAG TGAAACAACT TGAAGCAACA
GAAGCTGAAT TAGAAACAAA ACGTCAAGAT TTACTTTCTA AACAATCTGA ATTAAACGTA
ATGAAAGCTT CATTAGCATT AGAACAATCA TCAGCTGAAA GTTCTAAAGC TGGCTTAGAA
AAACAAAAAG CAGCTGCTGA AGCAGAGCAA GCACGCTTAG CTGCTGAACA AAAAGCTGCA
GCTGAAAAAG CCAAACAAGC TGCTGCAAAA CCAGCTAAAG CTGAAGTGAA AGCAGAAGCA
CCAGTTGCCT CTTCATCAAC AACAGAAGCA CAAGCACCAG CAAGCTCAAG CTCAGCAACT
GAATCAAGCA CGCAACAAAC AACTGAAACA ACTACACCAA GTACAGATAA TAGTGCAACA
GAAAATACTG GCTCTTCTTC ATCAGAACAA CCAGTACAAC CTACAACACC AAGCGATAAT
GGAAATAATG GTGGCCAAAC TGGTGGTGGA ACAGTTACAC CAACACCAGA ACCAACACCA
GCGCCTTCTG CTGATCCAAC AATCAATGCA TTGAACGTTC TACGTCAATC ATTAGGTTTA
CGTCCAGTAG TATGGGATGC AGGTTTGGCA GCTTCTGCAA CTGCTCGTGC AGCACAAGTT
GAAGCAGGTG GCATTCCAAA TGATCACTGG TCTCGTGGAG ATGAAGTTAT CGCAATTATG
TGGGCGCCAG GTAACTCAGT AATCATGGCG TGGTACAATG AAACAAACAT GGTAACAGCT
TCAGGAAGCG GTCACCGTGA TTGGGAAATT AACCCAGGTA TTACGCGTGT CGGTTTTGGT
TACTCAGGTA GCACAATCGT AGGACACTCA GCC
```

TABLE 1-continued

Nucleotide and Amino Acid Seqeuences of *E. faecalis* Genes.

EF129-4 (SEQ ID NO:484)
DN VDKKIEEKNQ EISSLKAKQG DLASQVSSLE
AEVSSVFDES MALREQKQTL KAKSEQLQQE ITNLNQRIEK RNEAIKNQAR DVQVNGQSTT
MLDAVLDADS VADAISRVQA VSTIVSANND LMQQQKEDQ AVVDKKAENE KKVKQLEATE
AELETKRQDL LSKQSELNVM KASLALEQSS AESSSKAGLEK QKAAAEAEQA RLAAEQKAAA
EKAKQAAAKP AKAEVKAEAP VASSSTTEAQ APASSSSATE SSTQQTTETT TPSTDNSATE
NTGSSSSEQP VQPTTPSDNG NNGGQTGGGT VTPTPEPTPA PSADPTINAL NVLRQSLGLR
PVVWDAGLAA SATARAAQVE AGGIPNDHWS RGDEVIAIMW APGNSVIMAW YNETNMVTAS
GSGHRDWEIN PGITRVGFGY SGSTIVGHSA

EF130-1 (SEQ ID NO:485)
TGATACATTA AAAGGAGGGA AAATATGCGC CCAAAAGAGA AAAAAGAGG AAAAAATTGG
TTAATCAACA GTTTATTAGT TTTACTATTT ATCATTGGCT TAGCCTTAAT TTTTAACAAT
CAGATACGTA GTTGGGTGGT TCAACAAAAT AGCCGCTCGT ACGCCGTTAG CAAGTTGAAA
CCAGCTGATG TGAAGAAAAA TATGGCTCGT GAAACAACGT TTGACTTTGA TTCAGTTGAG
TCCTTGAGCA CAGAAGCGGT GATGAAAGCC CAATTTGAAA ACAAAAACTT ACCTGTGATT
GGTGCCATTG CGATACCAAG TGTCGAAATT AATTTGCCCA TTTTTAAAGG ATTGTCCAAT
GTCGCTTTAT TAACTGGTGC CGGGACCATG AAAGAAGATC AAGTCATGGG GAAAAACAAT
TATGCCTTGG CTAGTCATCG AACGGAAGAT GGCGTTTCCT TATTTTCACC TTTAGAAAGA
ACCAAAAAAG ACGAACTCAT TTATATCACT GATTTATCTA CTGTTTATAC ATACAAAATA
ACTTCTGTAG AAAAAATCGA ACCAACCCGT GTTGAGTTAA TTGATGACGT TCCTGGTCAA
AATATGATTA CCTTAATTAC CTGTGGCGAT TTACAAGCAA CGACGCGAAT TGCTGTTCAA
GGAACATTAG CAGCAACGAC GCCTATTAAA GACGCCAACG ACGATATGTT GAAGGCTTTC
CAATTGGAGC AAAAAACTTT AGCCGATTGG GTGGCTTAA

EF130-2 (SEQ ID NO:486)
YIKRRENMRP KEKKRGKNWL INSLLVLLFI IGLALIFNNQ IRSWVVQQNS RSYAVSKLKP
ADVKKMMARE TTFDFDSVES LSTEAVMKAQ FENKNLPVIG AIAIPSVEIN LPIFKGLSNV
ALLTGAGTMK EDQVMGKNNY ALASHRTEDG VSLFSPLERT KKDELIYITD LSTVYTYKIT
SVEKIEPTRV ELIDDVPGQN MITLITCGDL QATTRIAVQG TLAATTPIKD ANDDMLKAFQ
LEQKTLADWV A

EF130-3 (SEQ ID NO:487)
CGTTAG CAAGTTGAAA
CCAGCTGATG TGAAGAAAAA TATGGCTCGT GAAACAACGT TTGACTTTGA TTCAGTTGAG
TCCTTGAGCA CAGAAGCGGT GATGAAAGCC CAATTTGAAA ACAAAAACTT ACCTGTGATT
GGTGCCATTG CGATACCAAG TGTCGAAATT AATTTGCCCA TTTTTAAAGG ATTGTCCAAT
GTCGCTTTAT TAACTGGTGC CGGGACCATG AAAGAAGATC AAGTCATGGG GAAAAACAAT
TATGCCTTGG CTAGTCATCG AACGGAAGAT GGCGTTTCCT TATTTTCACC TTTAGAAAGA
ACCAAAAAAG ACGAACTCAT TTATATCACT GATTTATCTA CTGTTTATAC ATACAAAATA
ACTTCTGTAG AAAAAATCGA ACCAACCCGT GTTGAGTTAA TTGATGACGT TCCTGGTCAA
AATATGATTA CCTTAATTAC CTGTGGCGAT TTACAAGCAA CGACGCGAAT TGCTGTTCAA
GGAACATTAG CAGCAACGAC GCCTATTAAA GACGCCAACG ACGATATGTT GAAGGCTTTC
CAATTGGAGC AAAAAACTTT AGCQGATTGG GTGGCT

EF130-4 (SEQ ID NO:488)
VSKLKP
ADVKKNNARE TTFDFDSVES LSTEAVMKAQ FENKNLPVIG AIAIPSVEIN LPIFKGLSNV
ALLTGAGTMK EDQVMGKNNY ALASHRTEDG VSLFSPLERT KKDELIYITD LSTVYTYKIT
SVEKIEPTRV EL:DDVPGQN MITLITCGDL QATTRIAVQG TLAATTPIKD ANDDMLKAFQ
LEQKTLADWV A

EF131-1 (SEQ ID NO:489)
TAGGCGGAGG TAAGCGGTAT GCGTAAACGA CATGCAAAGA AAAGACATGG AGGAGTGAAT
TGGCTTTTTA TAGTATGTTT GTTGGTGGTG ATTGGTGGTA GTGGTTATTT AATAAAAACG
TTCTTTTTCA CTAGAGATTC ACAAGTTAGT CAAGAATCGA AAGTGGTCTT GGAAGAAGAT
CGCCGAAGTG ATAATTATGC GAATTTAACG AAAGAAATAG TTGCACCAGA TAGTGGCGAA
CTTGATCAAA AAATTCAAGA AACAAATTAT ATTGGTTCGG CTTTGATCAT TAAAGATGAT
CAGGTTTTAG TAAATAAAGG ATATGGCTTT GCCAATTTTG AAAAGCAACA AGCCAACACG
CCAAACACAA GGTTTCAGAT TGGCTCAATT CAAAAATCTT TTACCACAAC CTTGATCTTA
AAAGCAATTG AAGAAGGTAA ACTTACATTA GATACAAAAC TCGCTACGTT TTATCCGCAA
ATTCAAGGTG CTGAGGATAT TACGATTAGC GATATGTTGA ATATGACAAG TGGTTTAAAG
TTATCAGCAA TGCCTAATAA TATCGTTACC GATGAAGAAA TTATTCAATT TGTTAAACAA
AATACCATTC AAGTCAATAA AGGAAAATAC AATTATTCCC CAGTAAATTT TGTCCTTTTA
GCAGGAATGT TAGAGAAAAT GTATCAACGT ACCTATCAAG AATTATTTAA TAATCTTTAT
CACAAAACGG CTGGTTTAAA GAATTTTGGC TTCTATGAAA CCTTATTGGA ACAGCCCAAT
AATTCAACAA GTTATAAATG GACAGAAGAT AATTCATATA ACCAAGTGCT CTCAATTCCT
GCAGCTAGTT TTGCCCATGA ATTTGGGACT GGTAATGTGG ATATGACGAC AGGTGATTTG
TATTGGTACT TACATCAATT AACGAGTGGA CATTTAGTTT CCACCGCACT TTTGCAAAAA
TTATGGACGT CTTCTCAGCA AAGCTCTTAT CATGGCGGCA TCTATGTTCA TGATAATTAT
TTACGTTTAC ACGGCGTTGA AGCGGGTCAA CAAGCCCTGG TTTTATTTTC AAAAGATATG
AAGACAGGGG TCATATTGCT AACTAACTGT GTGAATCCAG CGAAATACAA AGAATTAATT
GGTTCGTTGT TCCATGATGT AACCAATTTA ACTGTTAAAT TTTAA

EF131-2 (SEQ ID NO:490)
MRKRH AKKRHGGVNW LFIVCLLWI GGSGYLIKTF FFTRDSQVSQ ESKWLEEDR

TABLE 1-continued

Nucleotide and Amino Acid Seqeuences of *E. faecalis* Genes.

RSDNYANLTK EIVAPDSGEL DQKIQETNYI GSALIIKDDQ VLVNKGYGFA NFEKQQANTP
NTRFQIGSIQ KSFTTTLILK AIEEGKLTLD TKLATFYPQI QGAEDITISD MLNMTSGLKL
SAMPNNIVTD EEIIQFVKQN TIQVNKGKYN YSPVNFVLLA GMLEKMYQRT YQELFNNLYH
KTAGLKNFGF YETLLEQPNN STSYKWTEDN SYNQVLSIPA ASFAHEFGTG NVDMTTGDLY
WYLHQLTSGH LVSTALLQKL WTSSQQSSYH GGIYVHDNYL RLHGVEAGQQ ALVLFSKDMK
TGVILLTNCV NPAKYKELIG SLFHDVTNLT VKF

EF131-3 (SEQ ID NO:491)
TTT AATAAAAACG
TTCTTTTTCA CTAGAGATTC ACAAGTTAGT CAAGAATCGA AAGTGGTCTT GGAAGAAGAT
CGCCGAAGTG ATAATTATGC GAATTTAACG AAAGAAATAG TTGCACCAGA TAGTGGCGAA
CTTGATCAAA AAATTCAAGA AACAAATTAT ATTGGTTCGG CTTTGATCAT TAAAGATGAT
CAGGTTTTAG TAAATAAAGG ATATGGCTTT GCCAATTTTG AAAAGCAACA AGCCAACACG
CCAAACACAA GGTTTCAGAT TGGCTCAATT CAAAAATCTT TTACCACAAC CTTGATCTTA
AAAGCAATTG AAGAAGGTAA ACTTACATTA GATACAAAAC TCGCTACGTT TTATCCGCAA
ATTCAAGGTG CTGAGGATAT TACGATTAGC GATATGTTGA ATATGACAAG TGGTTTAAAG
TTATCAGCAA TGCCTAATAA TATCGTTACC GATGAAGAAA TTATTCAATT TGTTAAACAA
AATACCATTC AAGTCAATAA AGGAAAATAC AATTATTCCC CAGTAAATTT TGTCCTTTTA
GCAGGAATGT TAGAGAAAAT GTATCAACGT ACCTATCAAG AATTATTTAA TAATCTTTAT
CACAAAACGG CTGGTTTAAA GAATTTTGGC TTCTATGAAA CCTTATTGGA ACAGCCCAAT
AATTCAACAA GTTATAAATG GACAGAAGAT AATTCATATA ACCAAGTGCT CTCAATTCCT
GCAGCTAGTT TTGCCCATGA ATTTGGGACT GGTAATGTGG ATATGACGAC AGGTGATTTG
TATTGGTACT TACATCAATT AACGAGTGGA CATTTAGTTT CCACCGCACT TTTGCAAAAA
TTATGGACGT CTTCTCAGCA AAGCTCTTAT CATGGCGGCA TCTATGTTCA TGATAATTAT
TTACGTTTAC ACGGCGTTGA AGCGGGTCAA CAAGCCCTGG TTTTATTTTC AAAAGATATG
AAGACAGGGG TCATATTGCT AACTAACTGT GTGAATACAG CGAAATACAA AGAATTAATT
GGTTCGTTGT TCCATGATGT AACCAATTTA ACTGTTAAAT TT

EF131-4 (SEQ ID NO:492)
LIKTF FFTRDSQVSQ ESKVVLEEDR
RSDNYANLTK EIVAPDSGEL DQKIQETNYI GSALIIKDDQ VLVNKGYGFA NFEKQQANTP
NTRFQIGSIQ KSFTTTLILK AIEEGKLTLD TKLATFYPQI QGAEDITISD MLNMTSGLKL
SAMPNNIVTD EEIIQFVKQN TIQVNKGKYN YSPVNFVLLA GMLEKMYQRT YQELFNNLYH
KTAGLKNFGF YETLLEQPNN STSYKWTEDN SYNQVLSIPA ASFAHEFGTG NVDMTTGDLY
WYLHQLTSGH LVSTALLQKL WTSSQQSSYH GGIYVHDNYL RLHGVEAGQQ ALVLFSKDMK
TGVILLTNCV NPAKYKELIG SLFHDVTNLT VKF

EF132-1 (SEQ ID NO:493)
TAGTTTTCTAATCTCACCAAAACAAAAATTTTTAAGAAAGAAGGAGAGATCGTTATGATGAGAAAATGGAAAGTAGTA
GTGGGAAGTCTGGGAATGTTGATTGCTCTTTTTATATTCGGGGCATGTTCAACAAATAGTAAAGACAAAGATACAGTG
GCTTCGAACGAAAAATTAAAGGTAGTAGTTACTAATTCGATTTTAGCAGATATTACTGAAAATATAGCAAAAGATAAA
ATTGATTTACACAGTATCGTACCTATTGGGAAAGATCCCCACGAATATGAACCtTTGCCTGAAGATGTTCAAAAAACT
TCAAAAGCAGATTTGATTTTTTATAACGGTGTTAACTTGGAmACTGGAGGAAATGCTTGGTTTACAAAATTAGTAAAA
mATGCGAACAAAGAGGAAAACAAAGACTATTTTGCAGCAAGTGATGGCATAGATGTTATTTACTTAGAGGGTCAGAGT
GAGAAAGGGAAGGAAGATCCCCATGCTTGGTTAAATTTAGAAAACGGTATTATTTACGCTAAAAATATTGAAAAATGG
TTAGCGGAAAAAGATCCTGATAATAAAAAATTCTATAAAGAAAATCTAGATAAGTATATTGAAAAGTTGGATTCTCTA
GACAAAGAAGCTAAATCTAAATTTGCTTCAATTCCGAATGATAAAAAAATGATTGTTACAAGTGAAGGATGCTTtAAA
TATTTCTCGAAAGCGTATAATGTGCCTTCTGCTTACATTTGGGAAAtCAACACTGAAGAAGAAGGAACACCAGATCAA
ATAAAACACTTAGTTGAAAAATTACGCACAACAAAAGTTCCCTCCTTATTCGTAGAAAGTAGTGTGGACGATAGACCG
ATGAAAACAGTATCAAAAGATACCAATATTCCTATCTATTCAACGATTTTTACTGATTCAATTGCAGAAAAAGGACAA
GATGGTGATAGTTACTATGCGATGATGAAATGGAACCTGGATAAAATTGCTGAAGGCCTTTCGAAATAA

EF132-2 (SEQ ID NO:494)
MMRKWKVVVGSLGMLIALFIFGACSTNSKDKDTVASNEKLKVVVTNSILADITENIAKDKIDLHSIVPIGKDPHEYEP
LPEDVQKTSKADLIFYNGVNLXTGGNAWFTKLVKAANKEENKDYFAASDGIDVIYLEGQSEKGKEDPHAWLNLENGII
YAKNIEKWLAEKDPDNKKFYKENLDKYIEKLDSLDKEAKSKFASIPNDKKMIVTSEGCFKYFSKAYNVPSAYIWEINT
EEEGTPDQIKHLVEKLRTTKVPSLFVESSVDDRPMKTVSKDTNIPIYSTIFTDSIAEKGQDGDSYYAMMKWNLDKIAE
GLSK.

EF132-3 (SEQ ID NO:495)
ATGTTCAACAAATAGTAAAGACAAAGATACAGTGGCTTCGAACGAAAAATTAAAGGTAGTAGTTACTAATTCGATTTT
AGCAGATATTACTGAAAATATAGCAAAAGATAAAATTGATTTACACAGTATCGTACCTATTGGGAAAGATCCCCACGA
ATATGAACCtTTGCCTGAAGATGTTCAAAAAACTTCAAAAGCAGATTTGATTTTTTATAACGGTGTTAACTTGGAmAC
TGGAGGAAATGCTTGGTTTACAAAATTAGTAAAmATGCGAACAAAGAGGAAAACAAAGACTATTTTGCAGCAAGTGA
TGGCATAGATGTTATTTACTTAGAGGGTCAGAGTGAGAAAGGGAAGGAAGATCCCCATGCTTGGTTAAATTTAGAAAA
CGGTATTATTTACGCTAAAAATATTGAAAAATGGTTAGCGGAAAAAGATCCTGATAATAAAAAATTCTATAAAGAAAA
TCTAGATAAGTATATTGAAAAGTTGGATTCTCTAGACAAAGAAGCTAAATCTAAATTTGCTTCAATTCCGAATGATAA
AAAAATGATTGTTACAAGTGAAGGATGCTTtAAATATTTCTCGAAAGCGTATAATGTGCCTTCTGCTTACATTTGGGA
AAtCAACACTGAAGAAGAAGGAACACCAGATCAAATAAAACACTTAGTTGAAAAATTACGCACAACAAAAGTTCCCTC
CTTATTCGTAGAAAGTAGTGTGGACGATAGACCGATGAAAACAGTATCAAAAGATACCAATATTCCTATCTATTCAAC
GATTTTTACTGATTCAATTGCAGAAAAAGGACAAGATGGTGATAGTTACTATGCGATGATGAAATGGAACCTGGATAA
AATTGCTGAAGGCCTTTCGAAA

TABLE 1-continued

Nucleotide and Amino Acid Seqeuences of E. faecalis Genes.

EF132-4 (SEQ ID NO:496)
CSTNSKDKDTVASNEKLKVVVTNSILADITENIAKDKIDLHSIVPIGKDPHEYEPLPEDVQKTSKADLIFYNGVNLXT
GGNAWFTKLVKAANKEENKDYFAASDGIDVIYLEGQSEKGKEDPHAWLNLENGIIYAKNIEKWLAEKDPDNKKFYKEN
LDKYIEKLDSLDKEAKSKFASIPNDKKMIVTSEGCFKYFSKAYNVPSAYIWEINTEEEGTPDQIKHLVEKLRTTKVPS
LFVESSVDDRPMKTVSKDTNIPIYSTIFTDSIAEKGQDGDSYYAMMKWNLDKIAEGLSK

TABLE 2

Closest matching sequences between the polypeptides of the present invention and sequences in GenBank and Derwent databases.

| Query | GenBank Acess. No. | GenBank Gene Description | BLAST Score | BLAST P-Value |
|---|---|---|---|---|
| EF002-2 | gi|2338759 | (AF018073) periplasmic sorbitol-binding protein; SmoE [Rhodobacter] | 113 | 3.60E−18 |
| EF003-2 | gi|1552773 | hypothetical [Escherichia coli]>gn1|PID|d1012634 hypothetical 29.4 | 278 | 1.20E−53 |
| EF003-2 | gi|2196996 | lipoprotein homolog [Treponema pallidum]>gi|2108234 29K protein | 309 | 3.30E−44 |
| EF003-2 | gi|146649 | lipoprotein-28 precursor [Escherichia coli]>gi|290510 | 263 | 9.20E−40 |
| EF003-2 | gi|148838 | 28 3 kDa membrane protein [Haemophilus influenzae] | 197 | 2.10E−39 |
| EF003-2 | gi|1573614 | 28 kDa membrane protein (hlpA) [Haemophilus influenzae] | 197 | 7.80E−39 |
| EF003-2 | gi|2314748 | (AE000654) outer membrane protein [Helicobacter pylori] | 263 | 4.60E−37 |
| EF003-2 | gi|349530 | lipoprotein [Pasteurella haemolytica]>gi|150508 lipoprotein | 189 | 4.10E−29 |
| EF003-2 | gn1|PID|e118435 | similar to hypothetical proteins [Bacillus subtilis] | 158 | 2.70E−26 |
| EF003-2 | gi|349532 | lipoprotein [Pasteurella haemolytica]>pir|JN0753|JN0753 outer | 200 | 1.20E−25 |
| EF003-2 | gi|1336657 | lipoprotein [Bacillus subtilis] | 182 | 2.70E−25 |
| EF003-2 | gn1|PID|e233873 | hypothetical protein [Bacillus subtilis]>gn1|PID|e1182900 | 186 | 1.30E−23 |
| EF003-2 | gi|294071 | lipoprotein 3 [Pasteurella haemolytica] | 199 | 6.60E−23 |
| EF003-2 | gi|349531 | lipoprotein [Pasteurella haemolytica]>pir|JN0752|JN0752 outer | 198 | 1.30E−20 |
| EF003-2 | gi|294070 | lipoprotein 2 [Pasteurella haemolytica] | 198 | 1.80E−20 |
| EF005-2 | gi|537235 | Kenn Rudd identifies as gpmB [Escherichia coli]>gi|1790856 | 127 | 6.20E−12 |
| EF006-2 | gi|1552773 | hypothetical [Escherichia coli]>gn1|PID|d1012634 hypothetical 29.4 | 255 | 1.40E−60 |
| EF006-2 | gi|349532 | lipoprotein [Pasteurella haemolytica]>pir|JN0753|JN0753 outer | 221 | 6.40E−49 |
| EF006-2 | gi|2314748 | (AE000654) outer membrane protein [Helicobacter pylori] | 283 | 2.70E−48 |
| EF006-2 | gi|2196996 | lipoprotein homolog [Treponema pallidum]>gi|2108234 29K protein | 267 | 4.40E−47 |
| EF006-2 | gn1|PID|e118435 | similar to hypothetical proteins [Bacillus subtilis] | 359 | 1.80E−44 |
| EF006-2 | gi|349531 | lipoprotein [Pasteurella haemolytica]>pir|JN0752|JN0752 outer | 218 | 3.80E−41 |
| EF006-2 | gi|294071 | lipoprotein 3 [Pasteurella haemolytica] | 220 | 2.30E−38 |
| EF006-2 | gi|146649 | lipoprotein-28 precursor [Escherichia coli]>gi|290510 | 193 | 2.60E−38 |
| EF006-2 | gi|294070 | lipoprotein 2 [Pasteurella haemolytica] | 218 | 1.20E−36 |
| EF006-2 | gi|148838 | 28 3 kDa membrane protein [Haemophilus influenzae] | 112 | 8.50E−34 |
| EF006-2 | gi|1573614 | 28 kDa membrane protein (hlpA) [Haemophilus influenzae] | 112 | 1.50E−33 |
| EF006-2 | gi|349530 | lipoprotein [Pasteurella haemolytica]>gi|150508 lipoprotein | 114 | 4.30E−29 |
| EF006-2 | gi|294069 | lipoprotein 1 [Pasteurella haemolytica] | 114 | 1.30E−27 |
| EF006-2 | gi|1336657 | lipoprotein [Bacillus subtilis] | 202 | 2.10E−26 |
| EF006-2 | gn1|PID|e233873 | hypothetical protein [Bacillus subtilis]>gn1|PID|e1182900 | 200 | 6.50E−25 |
| EF008-2 | gi|493017 | endocarditis specific antigen [Enterococcus faecalis] | 1590 | 2.70E−211 |
| EF008-2 | gi|393269 | adhesion protein [Streptococcus pneumoniae] | 986 | 1.80E−129 |
| EF008-2 | gi|153834 | adhesin specific for salivary pellicle of dental surfaces | 973 | 1.00E−127 |
| EF008-2 | gi|1575030 | surface adhesin A precursor [Streptococcus pneumoniae] | 934 | 2.90E−126 |
| EF008-2 | gi|153826 | adhesin B [Streptococcus sanguis]>pir|A43583|A43583 adhesin B | 916 | 3.90E−126 |
| EF008-2 | gi|1184932 | ScbA [Streptococcus crista] | 915 | 3.40E−125 |
| EF008-2 | gi|1117994 | surface antigen A variant precursor [Streptococcus pneumoniae] | 917 | 5.60E−124 |
| EF008-2 | gi|310633 | adhesin [Streptococcus gordonii] | 891 | 6.00E−122 |
| EF008-2 | gn1|PID|e255529 | lipoprotein [Staphylococcus epidermidis] | 476 | 1.20E−99 |
| EF008-2 | gi|1573330 | adhesin B precursor (fimA) [Haemophilus influenzae] | 380 | 1.60E−68 |
| EF008-2 | gi|1245464 | YfeA [Yersinia pestis]>gi|1245565 YfeA [Yersinia pestis] | 355 | 1.20E−64 |
| EF008-2 | gi|575075 | periplasmic-binding protein [Synechocystis sp.]>gn1|PID|d1018652 Mn | 321 | 1.70E−62 |
| EF008-2 | gi|1335912 | EwlA [Erysipelothrix rhusiopathiae] | 232 | 4.40E−42 |
| EF008-2 | gn1|PID|e118595 | similar to ABC transporter (membrane protein) [Bacillus] | 204 | 4.10E−38 |
| EF008-2 | gi|1777933 | TroA [Treponema pallidum] | 181 | 2.40E−35 |
| EF009-2 | gi|349531 | lipoprotein [Pasteurella haemolytica]>pir|JN0752|JN0752 outer | 391 | 4.00E−64 |
| EF009-2 | gi|1552773 | hypothetical [Escherichia coli]>gn1|PID|d1012634 hypothetical 29.4 | 359 | 1.90E−63 |
| EF009-2 | gi|294070 | lipoprotein 2 [Pasteurella haemolytica] | 391 | 6.40E−63 |
| EF009-2 | gi|349532 | lipoprotein [Pasteurella haemolytica]>pir|JN0753|JN0753 outer | 386 | 1.10E−61 |
| EF009-2 | gi|148838 | 28 3 kDa membrane protein [Haemophilus influenzae] | 286 | 5.60E−60 |
| EF009-2 | gi|1573614 | 28 kDa membrane protein (hlpA) [Haemophilus influenzae] | 286 | 7.60E−60 |
| EF009-2 | gi|294069 | lipoprotein 1 [Pasteurella haemolytica] | 122 | 4.70E−59 |
| EF009-2 | gi|146649 | lipoprotein-28 precursor [Escherichia coli]>gi|290510 | 326 | 2.20E−58 |
| EF009-2 | gi|349530 | lipoprotein [Pasteurella haemolytica]>gi|150508 lipoprotein | 239 | 7.80E−57 |
| EF009-2 | gi|294071 | lipoprotein 3 [Pasteurealla haemolytica] | 344 | 4.90E−56 |
| EF009-2 | gi|2314748 | (AE000654) outer membrane protein [Helicobacter pylori] | 319 | 4.20E−53 |
| EF009-2 | gi|2196996 | lipoprotein homolog [Treponema pallidum]>gi|2108234 29K protein | 312 | 2.60E−41 |
| EF009-2 | gi|1336657 | lipoprotein [Bacillus subtilis] | 234 | 4.00E−32 |
| EF009-2 | gn1|PID|e233873 | hypothetical protein [Bacillus subtilis]>gn1|PID|e1182900 | 242 | 1.40E−31 |
| EF009-2 | gn1|PID|e118435 | similar to hypothetical proteins [Bacillus subtilis] | 102 | 6.80E−22 |

TABLE 2-continued

Closest matching sequences between the polypeptides of the present invention and sequences in GenBank and Derwent databases.

| | | | | |
|---|---|---|---|---|
| EF011-2 | gn1\|PID\|d100965 | ferric anguibactin-binding protein precursor FatB of V. | 579 | 3.10E-98 |
| EF011-2 | gn1\|PID\|d100965 | ferric anguibactin-binding protein precursor FatB of V. | 579 | 3.10E-98 |
| EF011-2 | gn1\|PID\|e185374 | ceuE gene product [*Campylobacter coli*] | 284 | 1.30E-89 |
| EF011-2 | gn1\|PID\|e185374 | ceuE gene product [*Campylobacter coli*] | 284 | 1.30E-89 |
| EF011-2 | gi\|150756 | 40 kDa protein [Plasmid pJM1]>pir\|A29928\|A29928 membrane-associated | 222 | 2.80E-52 |
| EF011-2 | gi\|150756 | 40 kDa protein [Plasmid pJM1]>pir\|A29928\|A29928 membrane-associated | 222 | 2.80E-52 |
| EF012-2 | gi\|309662 | pheromone binding protein [Plasmid pCF10]>pir\|B53309\|B53309 | 266 | 8.70E-116 |
| EF012-2 | gi\|388269 | traC [Plasmid pAD1]>pir\|A53310\|A53310 pheromone cAD1 binding | 252 | 1.10E-109 |
| EF012-2 | gn1\|PID\|d101185 | TRAC [*Enterococcus faecalis*] | 281 | 3.60E-103 |
| EF012-2 | gn1\|PID\|d100655 | TraC [*Enterococcus faecalis*] | 277 | 2.30E-102 |
| EF012-2 | gi\|312940 | threonine kinase [*Streptococcus equisimilis*]>pir\|S28153\|S28153 | 227 | 1.90E-67 |
| EF012-2 | gi\|48808 | dciAE [*Bacillus subtilis*] | 228 | 1.70E-46 |
| EF012-2 | pir\|S16651\|S166 | dciAE protein - *Bacillus subtilis* | 228 | 1.00E-45 |
| EF012-2 | gn1\|PID\|e118149 | (AJ002571) DppE [*Bacillus subtilis*]>gn1\|PID\|e1183316 | 228 | 3.80E-45 |
| EF012-2 | gi\|40005 | OppA gene product [*Bacillus subtilis*] | 281 | 3.90E-44 |
| EF012-2 | gi\|143603 | sporulation protein [*Bacillus subtilis*]>gn1\|PID\|e1183163 | 281 | 7.70E-44 |
| EF012-2 | gn1\|PID\|d101563 | Periplasmic oligopeptide-binding protein precursor. | 152 | 2.20E-43 |
| EF012-2 | gi\|1574679 | oligopeptide binding protein (oppA) [*Haemophilus influenzae*] | 178 | 2.20E-42 |
| EF012-2 | gi\|47802 | Opp A (AA1–542) [*Salmonella typhimurium*]>gi\|47808 precursor | 128 | 1.00E-37 |
| EF012-2 | gi\|882550 | ORF_f535 [*Escherichia coli*]>gi\|1789397 (AE000384) f535; This 535 aa | 228 | 5.30E-36 |
| EF014-2 | pir\|D70070\|D700 | transcriptional regulator homolog ywtF - *Bacillus subtilis* | 101 | 1.40E-27 |
| EF014-2 | gn1\|PID\|e116988 | capsular polysaccharide synthesis protein [Streptococcus | 121 | 9.50E-27 |
| EF014-2 | gi\|2804769 | (AF030373) putative regulatory protein [*Streptococcus pneumoniae*] | 121 | 9.50E-27 |
| EF014-2 | gn1\|PID\|e289126 | unknown [*Streptococcus pneumoniae*] | 121 | 1.00E-24 |
| EF014-2 | gi\|2267239 | ORF1 [*Staphylococcus epidermidis*] | 234 | 1.50E-24 |
| EF014-2 | gi\|485275 | putative regulatory protein [*Streptococcus pneumoniae*] | 121 | 3.90E-24 |
| EF014-2 | gi\|2804735 | (AF030367) putative regulatory protein [*Streptococcus pneumoniae*] | 121 | 3.90E-24 |
| EF014-2 | gi\|2804747 | (AF030369) putative regulatory protein [*Streptococcus pneumoniae*] | 121 | 3.90E-24 |
| EF014-2 | gi\|1762327 | putative transcriptional regulator [*Bacillus subtilis*] | 185 | 2.80E-22 |
| EF014-2 | gi\|143156 | membrane bound protein [*Bacillus subtilis*]>gn1\|PID\|e1184471 | 116 | 1.10E-21 |
| EF014-2 | gn1\|PID\|d101895 | membrane bound protein LytR [Synechocystis sp.] | 113 | 6.20E-20 |
| EF014-2 | gi\|1276874 | EpsA [*Streptococcus thermophilus*] | 103 | 4.00E-17 |
| EF016-2 | gn1\|PID\|e118566 | similar to amino acid ABC transporter (binding protein) | 194 | 3.70E-35 |
| EF016-2 | gi\|40934 | arginine binding protein [*Escherichia coli*]>gi\|769793 artJ | 121 | 1.60E-31 |
| EF016-2 | gn1\|PID\|d101527 | Arginine-binding periplasmic protein 2 precursor [Escherichia | 121 | 4.80E-31 |
| EF016-2 | gi\|687652 | FliY [*Escherichia coli*]>gn1\|PID\|d1016464 FliY protein precursor. | 160 | 5.70E-31 |
| EF016-2 | gi\|2650410 | (AE001090) glutamine ABC transporter, periplasmic glutamine-binding | 122 | 3.30E-29 |
| EF016-2 | gi\|1649035 | high-affinity periplasmic glutamine binding protein [Salmonella] | 104 | 1.80E-27 |
| EF016-2 | gi\|1574634 | glutamine-binding periplasmic protein (glnH) [Haemophilus] | 174 | 2.50E-27 |
| EF016-2 | gi\|41569 | GlnH precursor (AA -22 to 226) [*Escherichia coli*]>gn1\|PID\|d1015250 | 106 | 4.70E-27 |
| EF016-2 | gn1\|PID\|d101527 | Arginine-binding periplasmic protein 1 precursor [Escherichia | 109 | 3.70E-26 |
| EF016-2 | gi\|769791 | art1 [*Escherichia coli*]>gi\|769791 art1 [*Escherichia coli*] | 127 | 2.30E-25 |
| EF016-2 | gn1\|PID\|d100892 | homologous to Gln-binding periplasmic proteins [Bacillus] | 117 | 8.50E-24 |
| EF016-2 | gi\|154125 | J protein [*Salmonella typhimurium*]>gi\|47718 reading frame hisJ | 118 | 2.10E-23 |
| EF016-2 | gn1\|PID\|d101688 | HISTIDINE-BINDING PERIPLASMIC PROTEIN PRECURSOR (HBP). | 117 | 4.50E-23 |
| EF016-2 | gi\|1166636 | histidine-binding periplasmic protein HisJ [*Escherichia coli*] | 117 | 6.60E-23 |
| EF017-2 | gi\|388269 | traC [Plasmid pAD1]>pir\|A53310\|A53310 pheromone cAD1 binding | 421 | 4.50E-128 |
| EF017-2 | gn1\|PID\|d101185 | TRAC [*Enterococcus faecalis*] | 417 | 5.10E-124 |
| EF017-2 | gn1\|PID\|d100655 | TraC [*Enterococcus faecalis*] | 414 | 4.40E-123 |
| EF017-2 | gi\|309662 | pheromone binding protein [Plasmid pCF10]>pir\|B53309\|B53309 | 415 | 2.40E-119 |
| EF017-2 | gi\|40005 | OppA gene product [*Bacillus subtilis*] | 294 | 6.20E-82 |
| EF017-2 | gi\|143603 | sporulation protein [*Bacillus subtilis*]>gn1\|PID\|e1183163 | 290 | 2.80E-79 |
| EF017-2 | gi\|312940 | threonine kinase [*Streptococcus equisimilis*]>pir\|S28153\|S28153 | 241 | 2.40E-71 |
| EF017-2 | gi\|48808 | dciAE [*Bacillus subtilis*] | 270 | 1.10E-61 |
| EF017-2 | gn1\|PID\|118149 | (AJ002571) DppE [*Bacillus subtilis*]>gn1\|PID\|e1183316 | 270 | 1.50E-61 |
| EF017-2 | pir\|S16651\|S166 | dciAE protein - *Bacillus subtilis* | 270 | 3.10E-60 |
| EF017-2 | gi\|304925 | periplasmic oligopeptide binding protein [*Escherichia coli*] | 171 | 2.60E-57 |
| EF017-2 | gi\|147014 | oligopeptide binding protein precursor [*Escherichia coli*] | 171 | 8.70E-56 |
| EF017-2 | gi\|47802 | Opp A (AA 1–542) [*Salmonella typhimurium*]>gi\|47808 precursor | 154 | 1.30E-52 |
| EF017-2 | gi\|882550 | ORF_f535 [*Escherichia coli*]>gi\|1789397 (AE000384) f535; This 535 aa | 135 | 5.50E-52 |
| EF017-2 | gi\|1574679 | oligopeptide binding protein (oppA) [*Haemophilus influenzae*] | 168 | 2.90E-43 |
| EF019-2 | gi\|438458 | likely N-terminal signal sequence; mature protein probably | 104 | 2.30E-17 |
| EF021-2 | gn1\|PID\|e311492 | unknown [*Bacillus subtilis*]>gn1\|PID\|e1184232 similar to ABC | 317 | 2.50E-103 |
| EF021-2 | bbs\|173803 | CD4+ T cell-stimulating antigen [Listeria monocytogenes, 85EO-1167, | 476 | 2.80E-81 |
| EF021-2 | gi\|581809 | tmbC gene product [*Treponema pallidum*]>pir\|A43595\|A43595 membrane | 152 | 3.20E-71 |
| EF021-2 | gi\|2688280 | (AE001143) basic membrane protein C (bmpC) [*Borrelia burgdorferi*] | 101 | 5.50E-27 |
| EF021-2 | gn1\|PID\|e117283 | membrane protein A [*Borrelia garinii*] | 142 | 6.50E-22 |
| EF021-2 | gn1\|PID\|e117283 | membrane protein A [*Borrelia burgdorferi*] | 141 | 9.20E-22 |
| EF021-2 | gn1\|PID\|e117283 | membrane protein A [*Borrelia burgdorferi*]>gi\|516592 membrane | 141 | 9.20E-22 |
| EF021-2 | gn1\|PID\|e117283 | bmpA (p39, ORF1) [*Borrelia burgdorferi*] | 141 | 1.70E-21 |
| EF021-2 | gi\|508421 | antigen P39 [*Borrelia burgdorferi*]>gi\|2688281 (AE001143) basic | 141 | 1.70E-21 |
| EF021-2 | gi\|1753225 | BmpA protein [*Borrelia burgdorferi*] | 141 | 2.70E-20 |
| EF021-2 | gn1\|PID\|e117282 | membrane protein A [*Borrelia afzelii*] | 141 | 8.60E-20 |
| EF021-2 | gn1\|PID\|e117283 | membrane protein A [*Borrelia afzelii*] | 141 | 8.60E-20 |
| EF021-2 | gn1\|PID\|e117283 | membrane protein A [*Borrelia afzelii*] | 141 | 8.60E-20 |
| EF021-2 | gn1\|PID\|e117282 | bmpA (p39, ORF1) [*Borrelia burgdorferi*] | 141 | 1.50E-19 |
| EF022-2 | gi\|312940 | threonine kinase [*Streptococcus equisimilis*]>pir\|S28153\|S28153 | 324 | 5.90E-66 |

TABLE 2-continued

Closest matching sequences between the polypeptides of the present invention and sequences in GenBank and Derwent databases.

| | | | | |
|---|---|---|---|---|
| EF022-2 | gi\|309662 | pheromone binding protein [Plasmid pCF10]>pir\|B53309\|B53309 | 307 | 5.60E-60 |
| EF022-2 | gnl\|PID\|d101185 | TRAC [*Enterococcus faecalis*] | 301 | 4.80E-59 |
| EF022-2 | gnl\|PID\|e118149 | (AJ002571) DppE [*Bacillus subtilis*]>gnl\|PID\|e1183316 | 170 | 5.10E-59 |
| EF022-2 | gi\|58808 | dciAE [*Bacillus subtilis*] | 170 | 5.20E-59 |
| EF022-2 | gnl\|PID\|d100655 | TraC [*Enterococcus faecalis*] | 299 | 2.80E-58 |
| EF022-2 | pir\|S16651\|S166 | dciAE protein - *Bacillus subtilis* | 170 | 1.60E-57 |
| EF022-2 | gi\|388269 | traC [Plasmid pAD1]>pir\|A53310\|A53310 pheromone cAD1 binding | 280 | 2.70E-53 |
| EF022-2 | gi\|40005 | OppA gene product [*Bacillus subtilis*] | 154 | 7.30E-48 |
| EF022-2 | gi\|143603 | sporulation protein [*Bacillus subtilis*]>gnl\|PID\|e1183163 | 154 | 3.10E-47 |
| EF022-2 | gi\|2688227 | (AE001139) oligopeptide ABC transporter, periplasmic | 215 | 1.00E-36 |
| EF022-2 | gi\|2281458 | (AF000366) oligopeptide permease homolog AII [*Borrelia burgdorferi*] | 215 | 1.00E-36 |
| EF022-2 | gi\|304925 | periplasmic oligopeptide binding protein [*Escherichia coli*] | 131 | 1.30E-35 |
| EF022-2 | gi\|147014 | oligopeptide binding protein precursor [*Escherichia coli*] | 131 | 1.80E-34 |
| EF022-2 | gi\|47802 | Opp A (AA 1-542) [*Salmonella typhimurium*]>gi\|47808 precursor | 138 | 4.90E-34 |
| EF023-2 | gi\|309662 | pheromone binding protein [Plasmid pCF10]>pir\|B53309\|B53309 | 231 | 4.70E-66 |
| EF023-2 | gi\|388269 | traC [Plasmid pAD1]>pir\|A53310\|A53310 pheromone cAD1 binding | 223 | 4.80E-62 |
| EF023-2 | gnl\|PID\|d101185 | TRAC [*Enterococcus faecalis*] | 226 | 1.00E-58 |
| EF023-2 | gnl\|PID\|d100655 | TraC [*Enterococcus faecalis*] | 226 | 4.40E-58 |
| EF023-2 | gi↑48808 | dciAE [*Bacillus subtilis*] | 157 | 1.20E-57 |
| EF023-2 | gnl\|PID\|e118149 | (AJ002571) DppE [*Bacillus subtilis*]>gnl\|PID\|e1183316 | 157 | 1.20E-57 |
| EF023-2 | pir\|S16651\|S166 | dciAE protein - *Bacillus subtilis* | 157 | 3.80E-56 |
| EF023-2 | gi\|40005 | OppA gene product [*Bacillus subtilis*] | 137 | 2.30E-53 |
| EF023-2 | gi\|143603 | sporulation protein [*Bacillus subtilis*]>gnl\|PID\|e1183163 | 133 | 6.90E-53 |
| EF023-2 | gi\|47802 | Opp A (AA 1-542) [*Salmonella typhimurium*]>gi\|47808 precursor | 135 | 2.00E-41 |
| EF023-2 | gi\|2688227 | (AE001139) oligopeptide ABC transporter, periplasmic | 187 | 9.40E-41 |
| EF023-2 | gi\|2281458 | (AF000366) oligopeptide permease homolog AII [*Borrelia burgdorferi*] | 187 | 1.90E-40 |
| EF023-2 | gi\|882550 | ORF_f535 [*Escherichia coli*]>gi\|1789397 (AE000384) f535; This 535 aa | 155 | 1.30E-38 |
| EF023-2 | gi\|304925 | periplasmic oligopeptide binding protein [*Escherichia coli*] | 130 | 9.00E-37 |
| EF023-2 | gi\|147014 | oligopeptide binding protein precursor [*Escherichia coli*] | 130 | 3.70E-34 |
| EF026-2 | gi\|2352482 | (AF005097) unknown [*Lactococcus lactis*] | 141 | 1.10E-23 |
| EF027-2 | gi\|309662 | pheromone binding protein [Plasmid pCF10]>pir\|B53309\|B53309 | 198 | 6.20E-71 |
| EF027-2 | gnl\|PID\|d100655 | TraC [*Enterococcus faecalis*] | 202 | 1.50E-68 |
| EF027-2 | gnl\|PID\|d101185 | TRAC [*Enterococcus faecalis*] | 202 | 1.50E-68 |
| EF027-2 | gi\|388269 | traC [Plasmid pAD1]>pir\|A53310\|A53310 pheromone cAD1 binding | 213 | 8.30E-68 |
| EF027-2 | gnl\|PID\|e118149 | (AJ002571) DppE [*Bacillus subtilis*]>gnl\|PID\|e1183316 | 222 | 3.70E-41 |
| EF027-2 | gi\|48808 | dciAE [*Bacillus subtilis*] | 222 | 4.90E-41 |
| EF027-2 | pir\|S16651\|S166 | dciAE protein - *Bacillus subtilis* | 222 | 1.10E-39 |
| EF027-2 | gi\|40005 | OppA gene product [*Bacillus subtilis*] | 251 | 4.10E-39 |
| EF027-2 | gi\|143603 | sporulation protein [*Bacillus subtilis*]>gnl\|PID\|e1183163 | 247 | 5.80E-39 |
| EF027-2 | gi\|312940 | threonine kinase [*Streptococcus equisimilis*]>pir\|S28153\|S28153 | 233 | 8.90E-33 |
| EF027-2 | gi\|2688227 | (AE001139) oligopeptide ABC transporter, periplasmic | 131 | 2.40E-24 |
| EF027-2 | gi\|2281458 | (AF000366) oligopeptide permease homolog AII [*Borrelia burgdorferi*] | 131 | 2.40E-24 |
| EF027-2 | gi\|2281468 | (AF000948) OppAIV [*Borrelia burgdorferi*]>gi\|2689891 (AE000792) | 117 | 3.00E-20 |
| EF027-2 | gi\|1574679 | oligopeptide binding protein (oppA) [*Haemophilus influenzae*] | 130 | 3.50E-20 |
| EF028-2 | gnl\|PID\|d102047 | *B. subtilis* alkaline phosphatase IIIA; P19405 secretory | 996 | 3.60E-131 |
| EF028-2 | pir\|B39096\|B390 | alkaline phosphatase (EC 3.1.3.1) III precursor - Bacillus | 982 | 2.90E-129 |
| EF028-2 | gi\|470383 | alkaline phosphatase A [*Bacillus subtilis*]>gnl\|PID\|e1182942 | 803 | 4.80E-119 |
| EF028-2 | gi\|143324 | APase I [*Bacillus licheniformis*]>pir\|A44828\|A44828 alkaline | 184 | 3.00E-54 |
| EF028-2 | gi\|147243 | alkaline phosphatase precursor (EC 3.1.3.1) [*Escherichia coli*] | 183 | 8.30E-54 |
| EF028-2 | gi\|147237 | alkaline phosphatase precursor (EC 3.1.3.1) [*Escherichia coli*] | 178 | 4.40E-53 |
| EF028-2 | gi\|147239 | alkaline phosphatase precursor (EC 3.1.3.1) [*Escherichia coli*] | 178 | 4.40E-53 |
| EF028-2 | gi\|147241 | alkaline phosphatase precursor (EC 3.1.3.1) [*Escherichia coli*] | 178 | 4.40E-53 |
| EF028-2 | gi\|1277127 | phoA gene product [Cloning vector pFW_phoA1]>gi\|1277130 phoA gene | 174 | 4.90E-53 |
| EF028-2 | gi\|147229 | alkaline phosphatase precursor (EC 3.1.3.1) [*Escherichia coli*] | 178 | 8.40E-53 |
| EF028-2 | gi\|818851 | alkaline phosphatase [synthetic construct] | 174 | 1.10E-52 |
| EF028-2 | gi\|147245 | alkaline phosphatase (phoA) (EC 3.1.3.1) [*Escherichia fergusonii*] | 177 | 1.20E-52 |
| EF028-2 | gi\|1472310 | alkaline phosphatase precursor (EC 3.1.3.1) [*Escherichia coli*] | 174 | 1.60E-52 |
| EF028-2 | gi\|470383 | alkaline phosphatase A [*Bacillus subtilis*]>gnl\|PID\|e1182942 | 803 | 4.80E-119 |
| EF028-2 | gi\|143324 | APase I [*Bacillus licheniformis*]>pir\|A44828\|A44828 alkaline | 184 | 3.00E-54 |
| EF028-2 | gi\|147243 | alkaline phosphatase precursor (EC 3.1.3.1) [*Escherichia coli*] | 183 | 8.30E-54 |
| EF028-2 | gi\|147237 | alkaline phosphatase precursor (EC 3.1.3.1) [*Escherichia coli*] | 178 | 4.40E-53 |
| EF028-2 | gi\|147239 | alkaline phosphatase precursor (EC 3.1.3.1) [*Escherichia coli*] | 178 | 4.40E-53 |
| EF028-2 | gi\|147241 | alkaline phosphatase precursor (EC 3.1.3.1) [*Escherichia coli*] | 178 | 4.40E-53 |
| EF028-2 | gi\|1277127 | phoA gene product [Cloning vector pFW_phoA1]>gi\|1277130 phoA gene | 174 | 4.90E-53 |
| EF028-2 | gi\|147229 | alkaline phosphatase precursor (EC 3.1.3.1) [*Escherichia coli*] | 178 | 8.40E-53 |
| EF028-2 | gi\|818851 | alkaline phosphatase [synthetic construct] | 174 | 1.10E-52 |
| EF028-2 | gi\|147245 | alkaline phosphatase (phoA) (EC 3.1.3.1) [*Escherichia fergusonii*] | 177 | 1.20E-52 |
| EF028-2 | gi\|147231 | alkaline phosphatase precursor (EC 3.1.3.1) [*Escherichia coli*] | 174 | 1.60E-52 |
| EF028-2 | gi\|147235 | alkaline phosphatase precursor (EC 3.1.3.1) [*Escherichia coli*] | 174 | 1.60E-52 |
| EF028-2 | gi\|1016010 | alkaline phosphatase with N-terminal PelB-leader and C-terminal | 174 | 1.60E-52 |
| EF029-2 | gi\|1750126 | YncB [*Bacillus subtilis*]>gnl\|PID\|e1183421 similar to micrococcal | 257 | 3.50E-55 |
| EF029-2 | gnl\|PID\|e118360 | similar to hypothetical proteins [*Bacillus subtilis*] | 263 | 7.80E-53 |
| EF029-2 | gi\|673492 | nuclease [*Staphylococcus aureus*]>pir\|A00790\|NCSAF micrococcal | 320 | 2.20E-39 |
| EF029-2 | gi\|532653 | thermonuclease [*Staphylococcus hyicus*] | 155 | 9.10E-39 |
| EF029-2 | gi\|47146 | thermonuclease [*Staphylococcus intermedius*]>pir\|S26079\|S26079 | 145 | 4.90E-32 |
| EF030-2 | gi\|48808 | dciAE [*Bacillus subtilis*] | 149 | 1.10E-66 |
| EF030-2 | gnl\|PID\|e118149 | (AJ002571) DppE [*Bacillus subtilis*]>gnl\|PID\|e1183316 | 149 | 1.50E-66 |

TABLE 2-continued

Closest matching sequences between the polypeptides of the present invention and sequences in GenBank and Derwent databases.

| | | | | |
|---|---|---|---|---|
| EF030-2 | pir\|S16651\|S166 | dciAE protein - *Bacillus subtilis* | 149 | 5.90E−66 |
| EF030-2 | gi"309662 | pheromone binding protein [Plasmid pCF10]>pir\|B53309\|B53309 | 227 | 7.40E−52 |
| EF030-2 | gn1\|PID\|d101185 | TRAC [*Enterococcus faecalis*] | 237 | 7.40E−52 |
| EF030-2 | gn1\|PID\|d100655 | TraC [*Enterococcus faecalis*] | 233 | 9.70E−51 |
| EF030-2 | gi\|388269 | traC [Plasmid pAD1]>pir\|A53310\|A53310 pheromone cAD1 binding | 229 | 3.00E−48 |
| EF030-2 | gi\|312940 | threonine kinase [*Streptococcus equisimilis*]>pir\|S28153\|S28153 | 277 | 3.00E−45 |
| EF030-2 | gi\|47802 | Opp A (AA 1–542) [*Salmonella typhimurium*]>gi\|47808 precursor | 125 | 8.50E−34 |
| EF030-2 | gi\|2688227 | (AE001139) oligopeptide ABC transporter, periplasmic | 211 | 4.80E−31 |
| EF030-2 | gi\|2281458 | (AF000366) oligopeptide permease homolog AII [*Borrelia burgdorferi*] | 211 | 4.80E−31 |
| EF030-2 | gi\|40005 | OppA gene product [*Bacillus subtilis*] | 148 | 1.20E−30 |
| EF030-2 | gi\|143603 | sporulation protein [*Bacillus subtilis*]>gn1\|PID\|e1183163 | 144 | 4.80E−30 |
| EF030-2 | gi-2281468 | (AF000948) OppAIV [*Borrelia burgdorferi*]>gi\|2689891 (AE000792) | 210 | 2.10E−29 |
| EF030-2 | gi-1574679 | oligopeptide binding protein (oppA) [*Haemophilus influenzae*] | 148 | 6.00E−29 |
| EF033-2 | gn1\|PID\|e118439 | similar to iron-binding protein [*Bacillus subtilis*] | 164 | 2.60E−14 |
| EF033-2 | pir\|S54437\|S544 | hemin binding protein - *Yersinia enterocolitica* | 108 | 1.40E−11 |
| EF033-2 | gi\|1619623 | hemin binding protein [*Yersinia enterocolitica*] | 108 | 2.00E−11 |
| EF036-2 | gn1\|PID\|d101022 | ORF108 [*Bacillus subtilis*]>gn1\|PID\|e1185766 alternate gene | 544 | 1.20E−96 |
| EF036-2 | gi\|2622858 | (AE000929) phosphate-binding protein PstS [*Methanobacterium*] | 183 | 1.40E−45 |
| EF036-2 | gi\|2622859 | (AE000929) phosphate-binding protein PstS homolog [*Methanobacterium*] | 158 | 2.40E−41 |
| EF036-2 | gi\|2688115 | (AE001132) phosphate ABC transporter, periplasmic phosphate-binding | 117 | 1.10E−12 |
| EF037-2 | gi\|2352482 | (AF005097) unknown [*Lactococcus lactis*] | 141 | 1.10E−23 |
| EF040-2 | gi\|1657516 | hypothetical protein [*Escherichia coli*]>gi\|1786511 (AE000139) | 208 | 1.90E−29 |
| EF040-2 | gi\|293265 | 2-5A-dependent RNase [*Mus musculus*]>pir\|B45771\|B45771 | 105 | 1.00E−17 |
| EF040-2 | gi\|287865 | G9a [*Homo sapiens*]>pir\|S30385\|S30385 G9a protein - human | 143 | 8.30E−14 |
| EF040-2 | gi\|311817 | erythroid ankyrin [*Mus musculus*]>pir\|S37771\|S37771 ankyrin, | 119 | 4.80E−13 |
| EF040-2 | gi\|191940 | ankyrin [*Mus musculus*]>pir\|I49502\|I49502 ankyrin - mouse | 119 | 4.90E−13 |
| EF040-2 | gi\|747710 | alt. ankyrin (varriant 2.2) [*Homo sapiens*] | 120 | 1.50E−12 |
| EF040-2 | gi\|178646 | ankyrin [*Homo sapiens*] | 120 | 1.80E−12 |
| EF040-2 | gi\|1845265 | ankyrin [*Homo sapiens*] | 120 | 1.80E−12 |
| EF040-2 | pir\|A35049\|A350 | ankyrin 1, erythrocyte splice form 2 - human | 120 | 1.80E−12 |
| EF040-2 | pir\|B35049\|B350 | ankyrin 1, erythrocyte splice form 3 - human | 120 | 1.80E−12 |
| EF040-2 | gi\|28702 | ankyrin (variant 2.1) [*Homo sapiens*]>pir\|S08275\|SJHUK ankyrin 1, | 120 | 1.80E−12 |
| EF041-2 | gi\|388269 | traC [Plasmid pAD1]>pir\|A53310\|A53310 pheromone cAD1 binding | 670 | 1.40E−87 |
| EF041-2 | gn1\|PID\|d100655 | TraC [*Enterococcus faecalis*] | 662 | 1.50E−85 |
| EF041-2 | gn1\|PID\|d101185 | TRAC [*Enterococcus faecalis*] | 662 | 1.50E−85 |
| EF041-2 | gi\|309662 | pheromone binding protein [Plasmid pCF10]>pir\|B53309\|B53309 | 648 | 1.20E−83 |
| EF041-2 | gi\|48808 | dciAE [*Bacillus subtilis*] | 218 | 1.20E−57 |
| EF041-2 | gn1\|PID\|e118149 | (AJ002571) DppE [*Bacillus subtilis*]>gn1\|PID\|e1183316 | 218 | 1.40E−57 |
| EF041-2 | pir\|S16651\|S166 | dciAE protein - *Bacillus subtilis* | 218 | 2.10E−56 |
| EF041-2 | gi\|882550 | ORF_f535 [*Escherichia coli*]>gi\|1789397 (AE000384) f535; This 535 aa | 146 | 7.30E−40 |
| EF041-2 | gi\|143603 | sporulation protein [*Bacillus subtilis*]>gn1\|PID\|e1183163 | 278 | 1.00E−34 |
| EF041-2 | gi\|40005 | OppA gene product [*Bacillus subtilis*] | 279 | 1.00E−34 |
| EF041-2 | gi\|47802 | Opp A (AA 1–542) [*Salmonella typhimurium*]>gi\|47808 precursor | 141 | 6.60E−30 |
| EF041-2 | gi\|304925 | periplasmic oligopeptide binding protein [*Escherichia coli*] | 160 | 1.90E−29 |
| EF041-2 | gi\|1574679 | oligopeptide binding protein (oppA) [*Haemophilus influenzae*] | 163 | 1.00E−28 |
| EF041-2 | gi\|147014 | oligopeptide binding protein precursor [*Escherichia coli*] | 160 | 1.50E−28 |
| EF041-2 | gi\|2253286 | (AF005657) plasminogen binding protein [*Borrelia burgdorferi*] | 134 | 5.00E−27 |
| EF045-2 | gi\|308854 | oligopeptide binding protein [*Lactococcus lactis*]>pir\|E53290\|E53290 | 437 | 3.20E−125 |
| EF045-2 | gi\|495181 | oligopeptide binding protein [*Lactococcus lactis*] | 426 | 9.70E−124 |
| EF045-2 | gi\|677945 | AppA [*Bacillus subtilis*]>gn1\|PID\|e1183158 oligopeptide ABC | 154 | 2.30E−31 |
| EF045-2 | gi↑293014 | peptide-binding protein [*Lactococcus lactis*]>pir\|B47098\|B47098 | 158 | 2.40E−14 |
| EF048-2 | gi\|1574060 | hypothetical [*Haemophilus influenzae*]>pir\|I64164\|I64164 | 250 | 2.30E−41 |
| EF048-2 | dbj\|\|AB001488_2 | (AB001488) SIMILAR TO C4-DICARBOXYLATE-BINDING PERIPLASMIC | 208 | 3.60E−34 |
| EF048-2 | gi\|466717 | No definition line found [*Escherichia coli*]>gi\|1790004 (AE000435) | 199 | 1.30E−30 |
| EF048-2 | gi\|46006 | periplasmic C4-dicarboxylate binding-protein [*Rhodobacter capsulatus*] | 162 | 1.40E−25 |
| EF048-2 | gi\|1573102 | hypothetical [*Haemophilus influenzae*]>pir\|H64143\|H64143 | 244 | 3.80E−25 |
| EF048-2 | gi\|2182530 | (AE000085) Y 4mM [*Rhizobium* sp. NGR234] | 114 | 5.60E−18 |
| EF048-2 | gi\|1572999 | hypothetical [*Haemophilus influenzae*]>pir\|E64141\|E64141 | 116 | 5.90E−15 |
| EF049-2 | gi\|149581 | maturation protein [*Lactobacillus paracasei*]>pir\|A44858\|A44858 | 241 | 2.40E−55 |
| EF049-2 | gi\|47198 | ORF (AA 1 to 299) [*Lactococcus lactis cremoris*]>pir\|S08083\|S08083 | 239 | 1.00E−54 |
| EF049-2 | gi\|532402 | maturation protein [*Lactococcus lactis*]>gi\|623055 proteinase | 239 | 6.20E−54 |
| EF049-2 | gi\|472835 | ORF1 [*Lactococcus lactis cremoris*] | 241 | 1.50E−53 |
| EF049-2 | gi\|39782 | 33 kDa lipoprotein [*Bacillus subtilis*]>gn1\|PID\|e325181 33 kDa | 128 | 8.90E−40 |
| EF051-2 | gn1\|PID\|d101142 | molybdate-binding periplasmic protein [*Synechocystis* sp.] | 173 | 3.20E−50 |
| EF051-2 | gn1\|PID\|e118602 | alternate gene name: yvsD; similar to molybdate-binding | 314 | 5.90E−50 |
| EF051-2 | gi\|1574546 | lsg locus hypothetical [*Haemophilus influenzae*]>pir\|A64175\|A64175 | 161 | 2.20E−43 |
| EF051-2 | gi\|504498 | periplasmic molybdate-binding protein [*Escherichia coli*]>gi\|1147817 | 148 | 1.40E−30 |
| EF051-2 | gi\|148939 | ORF 8 [*Haemophilus influenzae*]>pir\|S27583\|S27583 hypothetical | 150 | 8.10E−28 |
| EF054-2 | gi\|150556 | surface protein [Plasmid pCF10]>pir\|A41826\|A41856 probable | 1490 | 1.80E−192 |
| EF054-2 | gn1\|PID\|e236571 | cell wall anchoring signal [*Enterococcus faecalis*] | 515 | 8.10E−64 |
| EF054-2 | gi\|45738 | ORFC [*Enterococcus faecalis*]>pir\|JH204\|JH0204 hypothetical 30.5K | 372 | 1.60E−58 |
| EF054-2 | gi\|496506 | orf iota [*Streptococcus pyogenes*]>pir\|S68125\|S45091 hypothetical | 362 | 1.30E−43 |
| EF054-2 | gi\|160693 | sporozoite surface protein [*Plasmodium yoelii*]>pir\|A45559\|A45559 | 286 | 4.30E−33 |
| EF054-2 | gi\|1813523 | PbTRAP [*Plasmodium berghei*] | 305 | 1.30E−32 |
| EF054-2 | gn1\|PID\|e225687 | zinc finger protein [*Mus musculus*]>gn1\|PID\|e225688 zinc | 246 | 3.60E−26 |
| EF054-2 | gi\|2290394 | IgG and IgE immunoreactive antigen recognized by sera from patients | 242 | 1.40E−25 |
| EF054-2 | gi↑2290392 | IgG and IgE immunoreactive antigen recognized by sera from patients | 237 | 7.80E−25 |

TABLE 2-continued

Closest matching sequences between the polypeptides of the present invention and sequences in GenBank and Derwent databases.

| | | | | |
|---|---|---|---|---|
| EF054-2 | gi\|46523 | B antigen [*Streptococcus agalactiae*] | 232 | 2.80E−23 |
| EF054-2 | pir\|S15330\|FCSO | IgA Fc receptor precursor - *Streptococcus agalactiae* | 228 | 1.00E−22 |
| EF054-2 | gi\|1620100 | Pro- and Glu-rich, PENPEV (10x); similar to Streptococcus B | 210 | 3.10E−21 |
| EF054-2 | gi\|63686 | NF-M c-terminus [*Gallus gallus*] | 222 | 6.90E−21 |
| EF054-2 | gi\|63689 | NF-M protein [*Gallus gallus*]>pir\|S15762\|S15762 neurofilament triplet | 222 | 8.50E−21 |
| EF054-2 | gi\|757867 | TATA-box like sequence (Us11) [Human herpesvirus 1]>gi\|291493 18 | 194 | 4.10E−19 |
| EF059-2 | gn1\|PID\|e236571 | cell wall anchoring signal [*Enterococcus faecalis*] | 418 | 5.60E−95 |
| EF059-2 | gi\|150556 | surface protein [Plasmid pCF10]>pir\|A41826\|A41826 probable | 606 | 3.70E−87 |
| EF059-2 | gi\|45738 | ORFC [*Enterococcus faecalis*]>pir\|JH0204\|JH0204 hypothetical 30.5K | 366 | 9.30E−50 |
| EF059-2 | gi\|496520 | orf iota [*Streptococcus pyogenes*]>pir\|S68125\|S45091 hypothetical | 367 | 5.90E−44 |
| EF059-2 | gi\|160693 | sporozoite surface protein [*Plasmodium yoelii*]>pir\|A45559\|A45559 | 344 | 1.10E−38 |
| EF059-2 | gi\|1813523 | PbTRAP [*Plasmodium berghei*] | 295 | 2.50E−32 |
| EF059-2 | gi\|2290394 | IgG and IgE immunoreactive antigen recognized by sera from patients | 251 | 3.00E−29 |
| EF059-2 | gi\|2290392 | IgG and IgE immunoreactive antigen recognized by sera from patients | 251 | 3.40E−29 |
| EF059-2 | gi\|1620100 | Pro- and Glu-rich, PENPEV (10x); similar to Streptococcus B | 253 | 6.40E−27 |
| EF059-2 | gi\|46521 | Fc receptor [*Streptococcus agalactiae*]>pir\|A60234\|A60234 IgA Fc | 197 | 2.70E−26 |
| EF059-2 | gi\|46523 | B antigen [*Streptococcus agalactiae*] | 232 | 9.30E−26 |
| EF059-2 | pir\|S15330\|FCSO | IgA Fc receptor precursor - *Streptococcus agalactiae* | 232 | 9.30E−26 |
| EF059-2 | gn1\|PID\|e225687 | zinc finger protein [*Mus musculus*]>gn1\|PID\|e225688 zinc | 234 | 1.40E−22 |
| EF059-2 | gi\|425356 | zona pellucida protein [*Pseudopleuronectes americanus*] | 229 | 1.00E−21 |
| EF059-2 | gi\|457769 | Collagen [*Bombyx mori*]>pir\|S42886\|S42886 collagen - silkworm | 209 | 7.60E−19 |
| EF061-2 | gn1\|PID\|e236571 | cell wall anchoring signal [*Enterococcus faecalis*] | 925 | 8.10E−118 |
| EF061-2 | gi\|150556 | surface protein [Plasmid pCF10]>pir\|A41826\|A41826 probable | 350 | 1.50E−107 |
| EF061-2 | gi\|496520 | orf iota [*Streptococcus pyogenes*]>pir\|S68125\|S45091 hypothetical | 308 | 1.40E−58 |
| EF061-2 | gi\|45738 | ORFC [*Enterococcus faecalis*]>pir\|JH0204\|JH0204 hypothetical 30.5K | 322 | 6.40E−50 |
| EF061-2 | gi\|1813523 | PbTRAP [*Plasmodium berghei*] | 263 | 1.00E−26 |
| EF061-2 | gi\|160693 | sporozoite surface protein [*Plasmodium yoelii*]>pir\|A45559\|A45559 | 241 | 9.00E−25 |
| EF061-2 | gi\|63686 | NF-M c-terminus [*Gallus gallus*] | 232 | 2.10E−22 |
| EF061-2 | gi\|63689 | NF-M protein [*Gallus gallus*]>pir\|S15762\|S15762 neurofilament triplet | 232 | 2.60E−22 |
| EF061-2 | gi\|2290392 | IgG and IgE immunoreactive antigen recognized by sera from patients | 176 | 2.40E−21 |
| EF061-2 | gi\|1620100 | Pro- and Glu-rich, PENPEV (10x); similar to Streptococcus B | 165 | 2.70E−20 |
| EF061-2 | gn1\|PID\|e225687 | zinc finger protein [*Mus musculus*]>gn1\|PID\|e225688 zinc | 197 | 7.80E−19 |
| EF061-2 | gi\|160355 | interspersed repeat antigen [*Plasmodium falciparum*] | 199 | 8.20E−18 |
| EF061-2 | gi\|410750 | interspersed repeat antigen [*Plasmodium falciparum*] | 199 | 8.90E−18 |
| EF061-2 | gi\|2290388 | IgG and IgE immunoreactive antigen recognized by sera from patients | 182 | 1.40E−17 |
| EF061-2 | gi\|2290394 | IgG and IgE immunoreactive antigen recognized by sera from patients | 180 | 2.80E−17 |
| EF062-2 | gi\|47049 | asa1 gene product (AA 1–1296) [*Enterococcus faecalis*] | 3710 | 0 |
| EF062-2 | gi\|43324 | aggregation substance (ASP1) [*Enterococcus faecalis*] | 4003 | 0 |
| EF062-2 | gi\|2109266 | aggregation substance [*Enterococcus faecium*] | 5523 | 0 |
| EF062-2 | gi\|150555 | aggregation substance [Plasmid pCF10]>pir\|H41662\|H41662 150K mating | 6338 | 0 |
| EF062-2 | gi\|1100973 | SspB precursor [*Streptococcus gordonii*] | 110 | 9.90E−39 |
| EF062-2 | gi\|47248 | PAc protein precursor (AA −38 to 1527) [*Streptococcus mutans*] | 107 | 1.70E−38 |
| EF062-2 | gn1\|PID\|d101507 | surface protein antigen precursor [*Streptococcus sobrinus*] | 132 | 5.00E−36 |
| EF062-2 | gi\|47267 | cell surface antigen I/II [*Streptococcus mutans*]>pir\|S06839\|S06839 | 107 | 6.50E−36 |
| EF062-2 | bbs\|148453 | SpaA = endocarditis immunodominant antigen [*Streptococcus sobrinus*,] | 132 | 1.20E−35 |
| EF062-2 | gi\|47620 | antigen I/II [*Streptococcus sobrinus*]>pir\|A60338\|A60338 surface | 132 | 2.90E−35 |
| EF062-2 | pir\|A35186\|A351 | salivary agglutinin receptor precursor - Streptococcus | 109 | 2.10E−34 |
| EF062-2 | gi\|1100971 | SspA [*Streptococcus gordonii*] | 110 | 3.80E−32 |
| EF062-2 | gi\|1100975 | SspA [*Streptococcus gordonii*] | 110 | 2.30E−21 |
| EF063-2 | gi\|47049 | asa1 gene product (AA 1–1296) [*Enterococcus faecalis*] | 3716 | 0 |
| EF063-2 | gi\|43324 | aggregation substance (ASP1) [*Enterococcus faecalis*] | 4003 | 0 |
| EF063-2 | gi\|2109266 | aggregation substance [*Enterococcus faecium*] | 5523 | 0 |
| EF063-2 | gi\|150555 | aggregation substance [Plasmid pCF10]>pir\|H41662\|H41662 150K mating | 6338 | 0 |
| EF063-2 | gi\|1100973 | SspB precursor [*Streptococcus gordonii*] | 110 | 9.90E−39 |
| EF063-2 | gi\|47248 | PAc protein precursor (AA −38 to 1527) [*Streptococcus mutans*] | 107 | 1.70E−38 |
| EF063-2 | gn1\|PID\|d101507 | surface protein antigen precursor [*Streptococcus sobrinus*] | 132 | 5.00E−36 |
| EF063-2 | gi\|47267 | cell surface antigen I/II [*Streptococcus mutans*]>pir\|S06839\|S06839 | 107 | 6.50E−36 |
| EF063-2 | bbs\|148453 | SpaA = endocarditis immunodominant antigen [*Streptococcus sobrinus*,] | 132 | 1.20E−35 |
| EF063-2 | gi\|47620 | antigen I/II [*Streptococcus sobrinus*]>pir\|A60338\|A60338 surface | 132 | 2.90E−35 |
| EF063-2 | pir\|A35186\|A351 | salivary agglutinin receptor precursor - Streptococcus | 109 | 2.10E−34 |
| EF063-2 | gi\|1100971 | SspA [*Streptococcus gordonii*] | 110 | 3.80E−32 |
| EF063-2 | gi\|1100975 | SspA [*Streptococcus gordonii*] | 110 | 2.30E−21 |
| EF064-2 | gi\|47049 | asa1 gene product (AA 1–1296) [*Enterococcus faecalis*] | 3716 | 0 |
| EF064-2 | gi\|43324 | aggregation substance (ASP1) [*Enterococcus faecalis*] | 4003 | 0 |
| EF064-2 | gi\|2109266 | aggregation substance [*Enterococcus faecium*] | 5523 | 0 |
| EF064-2 | gi\|150555 | aggregation substance [Plasmid pCF10]>pir\|H41662\|H41662 150K mating | 6338 | 0 |
| EF064-2 | gi\|1100973 | SspB precursor [*Streptococcus gordonii*] | 110 | 9.90E−39 |
| EF064-2 | gi\|47248 | PAc protein precursor (AA −38 to 1527) [*Streptococcus mutans*] | 107 | 1.70E−38 |
| EF064-2 | gn1\|PID\|d101507 | surface protein antigen precursor [*Streptococcus sobrinus*] | 132 | 5.00E−36 |
| EF064-2 | gi\|47267 | cell surface antigen I/II [*Streptococcus mutans*]>pir\|S06839\|S06839 | 107 | 6.50E−36 |
| EF064-2 | bbs\|148453 | SpaA = endocarditis immunodominant antigen [*Streptococcus sobrinus*,] | 132 | 1.20E−35 |
| EF064-2 | gi\|47620 | antigen I/II [*Streptococcus sobrinus*]>pir\|A60338\|A60338 surface | 132 | 2.90E−35 |
| EF064-2 | pir\|A35186\|A351 | salivary agglutinin receptor precursor - Streptococcus | 109 | 2.10E−34 |
| EF064-2 | gi\|1100971 | SspA [*Streptococcus gordonii*] | 110 | 3.80E−32 |
| EF064-2 | gi\|1100975 | SspA [*Streptococcus gordonii*] | 110 | 2.30E−21 |
| EF068-2 | gi\|790398 | T06D8.1 [*Caenorhabditis elegans*] | 137 | 8.50E−17 |
| EF068-2 | gn1\|PID\|d102084 | membrane glycoprotein [Equine herpesvirus 1] | 210 | 5.80E−16 |

TABLE 2-continued

Closest matching sequences between the polypeptides of the present invention and sequences in GenBank and Derwent databases.

| | | | | |
|---|---|---|---|---|
| EF068-2 | gi\|2286204 | (AF011339) unknown [Acinetobacter calcoaceticus] | 121 | 8.40E-16 |
| EF068-2 | gi\|330862 | membrane glycoprotein [Equine herpesvirus 1]>pir\|H36802\|VGBEX1 | 208 | 1.10E-15 |
| EF068-2 | gi\|1707247 | partial CDS [Caenorhabditis elegans] | 131 | 3.70E-15 |
| EF068-2 | gn1\|PID\|d102084 | membrane glycoprotein [Equine herpesvirus 1] | 203 | 6.20E-15 |
| EF068-2 | gi\|213392 | antifreeze glycoprotein [Notothenia coriiceps]>pir\|A38420\|A38420 | 102 | 4.60E-13 |
| EF068-2 | gn1\|PID\|e125464 | (AL022022) PGRS-family protein [Mycobacterium tuberculosis] | 145 | 1.50E-12 |
| EF068-2 | gi\|951460 | FIM-C.1 gene product [Xenopus laevis]>pir\|A45155\|A45155 mucin | 109 | 2.70E-12 |
| EF069-2 | gi\|790398 | T06D8.1 [Caenorhabditis elegans] | 137 | 8.50E-17 |
| EF069-2 | gn1\|PID\|d102084 | membrane glycoprotein [Equine herpesvirus 1] | 210 | 5.80E-16 |
| EF069-2 | gi\|2286204 | (AF011339) unknown [Acinetobacter calcoaceticus] | 121 | 8.40E-16 |
| EF069-2 | gi\|330862 | membrane glycoprotein [Equine herpesvirus 1]>pir\|H36802\|VGBEX1 | 208 | 1.10E-15 |
| EF069-2 | gi\|1707247 | partial CDS [Caenorhabditis elegans] | 131 | 3.70E-15 |
| EF069-2 | gn1\|PID\|d102084 | membrane glycoprotein [Equine herpesvirus 1] | 203 | 6.20E-15 |
| EF069-2 | gi\|213392 | antifreeze glycoprotein [Notothenia coriiceps]>pir\|A38420\|A38420 | 102 | 4.60E-13 |
| EF069-2 | gn1\|PID\|e125464 | (AL022022) PGRS-family protein [Mycobacterium tuberculosis] | 145 | 1.50E-12 |
| EF069-2 | gi\|951460 | FIM-C.1 gene product [Xenopus laevis]>pir\|A45155\|A45155 mucin | 109 | 2.70E-12 |
| EF070-2 | gi\|790398 | T06D8.1 [Caenorhabditis elegans] | 137 | 8.50E-17 |
| EF070-2 | gn1\|PID\|d102084 | membrane glycoprotein [Equine herpesvirus 1] | 210 | 5.80E-16 |
| EF070-2 | gi\|2286204 | (AF011339) unknown [Acinetobacter calcoaceticus] | 121 | 8.40E-16 |
| EF070-2 | gi\|330862 | membrane glycoprotein [Equine herpesvirus 1]>pir\|H36802\|VGBEX1 | 208 | 1.10E-15 |
| EF070-2 | gi\|1707247 | partial CDS [Caenorhabditis elegans] | 131 | 3.70E-15 |
| EF070-2 | gn1\|PID\|d102084 | membrane glycoprotein [Equine herpesvirus 1] | 203 | 6.20E-15 |
| EF070-2 | gi\|213392 | antifreeze glycoprotein [Notothenia coriiceps]>pir\|A38420\|A38420 | 102 | 4.60E-13 |
| EF070-2 | gn1\|PID\|e125464 | (AL022022) PGRS-family protein [Mycobacterium tuberculosis] | 145 | 1.50E-12 |
| EF070-2 | gi\|951460 | FIM-C.1 gene product [Xenopus laevis]>pir\|A45155\|A45155 mucin | 109 | 2.70E-12 |
| EF071-2 | gn1\|PID\|e306428 | unnamed protein product [Bacteriophage r1t]>gi\|1353566 Lysin | 127 | 2.00E-37 |
| EF071-2 | gi\|853751 | N-acetylmuramoyl-L-alanine amidase [Bacteriophage A511] | 273 | 2.60E-36 |
| EF073-2 | gi\|143830 | xpaC [Bacillus subtilis]>gn1\|PID\|d1005803 hydrolysis of | 173 | 7.10E-16 |
| EF074-2 | gi\|1256698 | chitinase [Serratia marcescens]>gi\|1256698 chitinase [Serratia] | 618 | 2.60E"104 |
| EF074-2 | gi\|1763985 | chitinase A [Vibrio harveyi] | 526 | 2.80E-84 |
| EF075-2 | gi\|143156 | membrane bound protein [Bacillus subtilis]>gn1\|PID\|e1184471 | 593 | 1.70E-91 |
| EF075-2 | pir\|D70070\|D700 | transcriptional regulator homolog ywtF - Bacillus subtilis | 118 | 1.90E-59 |
| EF075-2 | gi\|1762327 | putative transcriptional regulator [Bacillus subtilis] | 148 | 9.60E-53 |
| EF075-2 | gi\|1276874 | EpsA [Streptococcus thermophilus] | 239 | 2.20E-33 |
| EF075-2 | gn1\|PID\|e289126 | unknown [Streptococcus pneumoniae] | 150 | 1.20E-27 |
| EF075-2 | gi\|485275 | putative regulatory protein [Streptococcus pneumoniae] | 150 | 2.50E-27 |
| EF075-2 | gi\|2804735 | (AF030367) putative regulatory protein [Streptococcus pneumoniae] | 150 | 2.50E-27 |
| EF075-2 | gi\|2804747 | (AF030369) putative regulatory protein [Streptococcus pneumoniae] | 150 | 2.50E-27 |
| EF075-2 | gn1\|PID\|e116988 | capsular polysaccharide synthesis protein [Streptococcus] | 148 | 5.30E-27 |
| EF075-2 | gi\|2804769 | (AF030373) putative regulatory protein [Streptococcus pneumoniae] | 148 | 5.30E-27 |
| EF075-2 | gi\|1147744 | PSR [Enterococcus hirae] | 109 | 2.10E-23 |
| EF075-2 | gi\|790435 | PSR [Enterococcus faecium]>pir\|S54177\|S54117 PSR protein - | 102 | 4.40E-19 |
| EF075-2 | gi\|2267239 | ORF1 [Staphylococcus epidermidis] | 109 | 8.50E-19 |
| EF075-2 | gn1\|PID\|d101895 | membrane bound protein LytR [Synechocystis sp.] | 121 | 2.80E-16 |
| EF077-2 | gn1\|PID\|d101135 | cadmium-transporting ATPase [Synechocystis sp.] | 396 | 2.30E-113 |
| EF077-2 | gi\|150719 | cadmium resistance protein [Plasmid pI258]>pir\|A32561\|A32561 | 373 | 8.60E-112 |
| EF077-2 | gi\|143753 | cadmium-efflux ATPase [Bacillus firmus]>pir\|D42707\|D42707 probable | 361 | 8.10E-111 |
| EF077-2 | gi\|152978 | E1-E2 cadmium efflux adenosine triphosphatase [Staphylococcus] | 381 | 4.30E-110 |
| EF077-2 | gn1\|PID\|e248808 | unknown [Mycobacterium tuberculosis] | 298 | 3.50E-107 |
| EF077-2 | gi\|495646 | ATPase [Transposon Tn5422] | 361 | 2.10E-106 |
| EF077-2 | gn1\|PID\|e118497 | similar to heavy metal-transporting ATPase [Bacillus] | 286 | 3.50E-104 |
| EF077-2 | gi\|1699049 | cadmium resistance protein [Lactococcus lactis] | 352 | 3.60E-100 |
| EF077-2 | gn1\|PID\|e118603 | similar to heavy metal-transporting ATPase [Bacillus] | 254 | 9.90E-100 |
| EF077-2 | gn1\|PID\|e306540 | unknown [Mycobacterium tuberculosis] | 352 | 5.20E-88 |
| EF077-2 | gn1\|PID\|e263525 | P-type ATPase [Mycobacterium tuberculosis]>gn1\|PID\|e249413 | 199 | 5.50E-86 |
| EF077-2 | gn1\|PID\|e264090 | unknown [Mycobacterium tuberculosis] | 250 | 3.00E-84 |
| EF077-2 | gn1\|PID\|d101135 | cadmium-transporting ATPase [Synechocystis sp.] | 260 | 1.00E-81 |
| EF077-2 | gi\|1773166 | probable copper-transporting atpase [Escherichia coli]>gi\|1786691 | 212 | 4.70E-80 |
| EF077-2 | gi\|1354935 | probable copper-transporting atpase [Escherichia coli] | 212 | 8.50E-79 |
| EF078-2 | gi\|143331 | alkaline phosphatase regulatory protein [Bacillus subtilis] | 257 | 5.50E-58 |
| EF078-2 | gi\|410142 | ORFX18 [Bacillus subtilis]>gn1\|PID\|e1185580 two-component sensor | 235 | 8.20E-51 |
| EF078-2 | gn1\|PID\|d101196 | homologous to sp:PHOR_BACSU [Bacillus subtilis] | 219 | 4.20E-44 |
| EF078-2 | gi\|1575578 | histidine protein kinase [Thermotoga maritima] | 191 | 7.10E-44 |
| EF078-2 | gi\|2182990 | histidine kinase [Lactococcus lactis cremoris] | 169 | 6.40E-40 |
| EF078-2 | gi\|2182992 | histidine kinase [Lactococcus lactis cremoris] | 152 | 1.10E-39 |
| EF078-2 | gn1\|PID\|d101134 | sensory transduction histidine kinase [Synechocystis sp.] | 259 | 3.90E-38 |
| EF078-2 | gi\|149296 | phosphate regulatory protein phoR (gtg start codon) [Klebsiella] | 228 | 7.60E-33 |
| EF078-2 | gi\|581188 | phoR gene product (AA 1–431) [Escherichia coli]>gi\|1657596 | 226 | 1.60E-32 |
| EF078-2 | gn1\|PID\|d101087 | sensory transduction histidine kinase [Synechocystis sp.] | 138 | 3.70E-32 |
| EF078-2 | gn1\|PID\|e266592 | unknown [Mycobacterium tuberculosis] | 232 | 1.10E-31 |
| EF078-2 | gi\|2182996 | histidine kinase [Lactococcus lactis cremoris] | 206 | 1.30E-31 |
| EF078-2 | gn1\|PID\|d101135 | sensory transduction histidine kinase [Synechocystis sp.] | 256 | 1.30E-31 |
| EF078-2 | gi\|294893 | phosphate regulatory protein phoR (gtg start codon) [Shigella] | 225 | 1.60E-31 |
| EF078-2 | gi\|288420 | drug sensory protein A [Synechocystis PCC6803]>gn1\|PID\|d1017420 | 106 | 2.50E-31 |
| EF079-2 | gi\|2098719 | putative fimbrial-associated protein [Actinomyces naeslundii] | 183 | 8.60E-26 |
| EF081-2 | gi\|467806 | penicillin-binding protein [Enterococcus faecalis] | 1356 | 2.10E-178 |
| EF081-2 | gi\|790429 | low affinity penicillin-binding protein 5 (PBP5) [Enterococcus] | 607 | 1.00E-78 |

TABLE 2-continued

Closest matching sequences between the polypeptides of the present invention and sequences in GenBank and Derwent databases.

| | | | | |
|---|---|---|---|---|
| EF081-2 | gnl\|PID\|e208365 | penicillin-binding protein 5 [*Enterococcus faecium*] | 604 | 1.10E−78 |
| EF081-2 | gi\|790433 | low affinity penicillin-binding protein 5 (PBP5) [Enterococcus] | 604 | 2.70E−78 |
| EF081-2 | gi\|790437 | low affinity penicillin-binding protein 5 (PBP5) [Enterococcus] | 602 | 5.10E−78 |
| EF081-2 | gi\|790431 | low affinity penicillin-binding protein 5 (PBP5) [Enterococcus] | 591 | 2.60E−77 |
| EF081-2 | gi\|43342 | D-alanyl-D-alanine carboxypeptidase [*Enterococcus hirae*] | 587 | 9.30E−77 |
| EF081-2 | gi\|49000 | D-alanyl-D-alanine carboxypeptidase [*Enterococcus hirae*] | 572 | 5.20E−74 |
| EF081-2 | gnl\|PID\|d100794 | penicillin-binding protein 2 [*Bacillus subtilis*] | 149 | 7.40E−24 |
| EF081-2 | gnl\|PID\|e315088 | MecA1 [*Staphylococcus sciuri*] | 111 | 4.40E−19 |
| EF081-2 | gnl\|PID\|e286651 | MecA protein [*Staphylococcus sciuri*] | 106 | 2.90E−18 |
| EF081-2 | gnl\|PID\|e316581 | MecA protein [*Staphylococcus sciuri*] | 111 | 2.90E−18 |
| EF081-2 | gnl\|PID\|e316607 | MecA2 protein [*Staphylococcus sciuri*] | 101 | 3.70E−14 |
| EF081-2 | gnl\|PID\|e316613 | MecA protein [*Staphylococcus sciuri*]>gi\|46613 mecA gene | 101 | 3.70E−14 |
| EF083-2 | gi\|496283 | lysin [Bacteriophage Tuc2009] | 436 | 6.20E−176 |
| EF083-2 | gi\|530798 | LysB [Bacteriophage phi-LC3] | 421 | 3.00E−175 |
| EF083-2 | gi\|166183 | muramidase [Bacteriophage CP-7] | 186 | 1.20E−21 |
| EF083-2 | gi\|166188 | muramidase [Bacteriophage CP-8]>pir\|Q0438\|MUBPC9 | 188 | 5.00E−21 |
| EF083-2 | gi\|623084 | muramidase; muramidase [Bacteriophage LL-H] | 193 | 8.40E−20 |
| EF083-2 | gi\|166175 | muramidase [Bacteriophage CP-1] | 175 | 3.40E−19 |
| EF083-2 | gnl\|PID\|e221272 | lysozyme [Bacteriophage CP-1]>pir\|A31086\|MUBPCP | 175 | 3.40E−19 |
| EF083-2 | pir\|JQ0437\|MUBP | N-acetylmuramoyl-L-alanine amidase (EC 3.5.1.28) - phage | 171 | 9.50E−19 |
| EF083-2 | gi\|410502 | LysA [Bacteriophage mv4]>pir\|S38477\|S38477 lytic enzyme lysA - | 187 | 8.90E−17 |
| EF083-2 | gi\|793850 | lysin [*Lactobacillus bacteriophage* phi adh]>gnl\|PID\|e1217314 lysin | 117 | 5.60E−15 |
| EF084-2 | gi\|2293312 | (AF008220) YtfP [*Bacillus subtilis*]>gnl\|PID\|e1185879 similar to | 438 | 1.70E−140 |
| EF084-2 | gi\|236734 | (AE000425) hypothetical 43.8 kD protein in rhsB-pit intergenic | 167 | 2.20E−51 |
| EF084-2 | gi\|912464 | No definition line found [*Escherichia coli*] | 167 | 6.00E−51 |
| EF084-2 | gnl\|PID\|d101127 | hypothetical protein [Synechocystis sp.]>pir\|S76678\|S76678 | 151 | 6.10E−42 |
| EF084-2 | gi\|1573954 | hypothetical [*Haemophilus influenzae*]>pir\|G64161\|G64161 | 142 | 2.90E−40 |
| EF085-2 | gi\|1209527 | protein histidine kinase [*Enterococcus faecalis*] | 2023 | 8.00E−279 |
| EF085-2 | gi\|467057 | phoR; B2168_C3_247 [*Mycobacterium leprae*]>pir\|S72905\|S72905 | 226 | 8.80E−23 |
| EF085-2 | gnl\|PID\|e119229 | SenX3 [*Mycobacterium bovis* BCG] | 222 | 3.10E−22 |
| EF085-2 | gnl\|PID\|e255152 | unknown [*Mycobacterium tuberculosis*]>gnl\|PID\|e321546 SenX3 | 222 | 3.10E−22 |
| EF085-2 | gi\|1778485 | PcoS homolog [*Escherichia coli*]>gi\|1786783 (AE000162) f480; This | 111 | 3.80E−16 |
| EF085-2 | gi\|149296 | phosphate regulatory protein phoR (gtg start codon) [Klebsiella] | 110 | 1.40E−14 |
| EF085-2 | gi\|581188 | phoR gene product (AA 1–431) [*Escherichia coli*]>gi\|1657596 | 103 | 5.30E−14 |
| EF085-2 | gi\|143331 | alkaline phosphatase regulatory protein [*Bacillus subtilis*] | 118 | 4.90E−13 |
| EF085-2 | gi\|537239 | alternate gene name phoM; CG Site No. 395 [*Escherichia coli*] | 126 | 9.50E−13 |
| EF085-2 | gi\|147251 | phoM [*Escherichia coli*]>gi\|809670 phoM protein (1 is 3rd base in | 126 | 9.50E−13 |
| EF085-2 | gi\|2182992 | histidine kinase [*Lactococcus lactis cremoris*] | 109 | 5.90E−12 |
| EF086-2 | gi\|437706 | alternative truncated translation product from E. coli [Streptococcus] | 221 | 3.00E−54 |
| EF086-2 | gi\|437705 | hyaluronidase [*Streptococcus pneumoniae*] | 221 | 1.60E−53 |
| EF086-2 | gi\|595847 | hyaluronate lyase [*Streptococcus agalactiae*]>pir\|A55137\|A55137 | 203 | 3.30E−44 |
| EF086-2 | gi\|705406 | hyaluronate lyase [*Staphylococcus aureus*] | 191 | 3.40E−42 |
| EF086-2 | gi\|562086 | hyaluronidase [*Propionibacterium acnes*] | 198 | 6.00E−27 |
| EF087-2 | gi\|437706 | alternative truncated translation product from E. coli [Streptococcus] | 221 | 3.00E−54 |
| EF087-2 | gi\|437705 | hyaluronidase [Streptococcus pneumoniae] | 221 | 1.60E−53 |
| EF087-2 | gi\|595847 | hyaluronate lyase [*Streptococcus agalactiae*]>pir\|A55137\|A55137 | 203 | 3.30E−44 |
| EF087-2 | gi\|705406 | hyaluronate lyase [*Staphylococcus aureus*] | 191 | 3.40E−42 |
| EF087-2 | gi\|562086 | hyaluronidase [*Propionibacterium acnes*] | 198 | 6.00E−27 |
| EF088-2 | gi\|437706 | alternative truncated translation product from E. coli [Streptococcus] | 221 | 3.00E−54 |
| EF088-2 | gi\|437705 | hyaluronidase [*Streptococcus pneumoniae*] | 221 | 1.60E−53 |
| EF088-2 | gi\|595847 | hyaluronate lyase [*Streptococcus agalactiae*]>pir\|A55137\|A55137 | 203 | 3.30E−44 |
| EF088-2 | gi\|705406 | hyaluronate lyase [*Staphylococcus aureus*] | 191 | 3.40E−42 |
| EF088-2 | gi\|562086 | hyaluronidase [*Propionibacterium acnes*] | 198 | 6.00E−27 |
| EF091-2 | gi\|556016 | similar to plant water stress proteins; ORF2 [*Bacillus subtilis*] | 198 | 5.50E−21 |
| EF091-2 | gi\|235333 | (AF016513) Ce-LEA [*Caenorhabditis elegans*] | 189 | 2.40E−17 |
| EF091-2 | gnl\|PID\|e353216 | seed maturation protein homolog [*Arabidopsis thaliana*] | 146 | 3.60E−11 |
| EF091-2 | gi\|1161171 | late embryogenesis abundant protein [*Picea glauca*] | 132 | 5.70E−11 |
| EF091-2 | pir\|S04909\|S049 | embryonic protein DC8 (clone 8/10) - carrot | 127 | 6.50E−11 |
| EF092-2 | gi\|2689898 | (AE000792) PTS system, cellobiose-specific IIB component (celA) | 145 | 4.00E−27 |
| EF092-2 | gnl\|PID\|d102048 | B. subtilis, cellobiose phosphotransferase system, celA; | 116 | 1.40E−26 |
| EF096-2 | gi\|147329 | transport protein [*Escherichia coli*]>gnl\|PID\|d1015409 | 532 | 2.10E−91 |
| EF096-2 | gi\|1573475 | spermidine/putrescine-binding periplasmic protein precursor (potD) | 527 | 1.10E−79 |
| EF096-2 | gi\|1574803 | spermidine/putrescine-binding periplasmic protein precursor (potD) | 468 | 1.60E−75 |
| EF096-2 | gi\|1142681 | Lpp38 [*Pasteurella haemolytica*] | 446 | 4.40E−72 |
| EF096-2 | gnl\|PID\|d101526 | Putrescine transport protein PotF [*Escherichia coli*] | 216 | 1.50E−54 |
| EF096-2 | gi\|147334 | periplasmic putrescine binding protein [*Escherichia coli*] | 216 | 2.10E−53 |
| EF096-2 | gi\|2688565 | (AE001165) spermidine/putrescine ABC transporter, | 240 | 2.00E−48 |
| EF096-2 | gi\|1881733 | PotD [*Salmonella typhimurium*] | 253 | 2.70E−28 |
| EF096-2 | gnl\|PID\|d101926 | spermidine/putrescine-binding periplasmic protein | 243 | 4.20E−26 |
| EF096-2 | gnl\|PID\|e152543 | potF gene product [*Clostridium perfringens*] | 204 | 3.30E−21 |
| EF097-2 | gi\|622991 | mannitol transport protein [*Bacillus stearothermophilus*] | 547 | 4.90E−93 |
| EF097-2 | gi\|42034 | mannitol permease [*Escherichia coli*]>gi\|466737 mannitol-specific | 535 | 5.50E−85 |
| EF097-2 | gi\|633650 | enzyme II (mannitol) [*Staphylococcus carnosus*]>pir\|S68193\|S22385 | 516 | 2.10E−82 |
| EF097-2 | gi\|882462 | protein-N(pi)-phosphohistidine-sugar phosphotransferase [Escherichia] | 509 | 3.00E−76 |
| EF097-2 | gi\|312763 | protein-N(pi)-phosphohistidine-sugar phosphotransferase [Escherichia] | 357 | 7.50E−70 |
| EF097-2 | gnl\|PID\|d100966 | homologue of mannitol transport protein of B. | 492 | 3.10E−62 |
| EF097-2 | gnl\|PID\|d100792 | mannitol-specific phophotransferase enzyme II [Bacillus] | 484 | 5.20E−61 |

TABLE 2-continued

Closest matching sequences between the polypeptides of the present invention and sequences in GenBank and Derwent databases.

| | | | | |
|---|---|---|---|---|
| EF097-2 | gi\|1673855 | (AE000020) *Mycoplasma pneumoniae*, PTS system mannitol-specific | 232 | 3.50E−59 |
| EF097-2 | gn1\|PID\|d100651 | phosphotransferase enzyme II, mannitol-specific [Mycoplasma] | 158 | 8.20E−18 |
| EF097-2 | pir\|S77757\|S777 | phosphotransferase system enzyme II (EC 2.7.1.69), | 103 | 2.00E−13 |
| EF100-2 | gi\|2058546 | ComYC [*Streptococcus gordonii*] | 193 | 7.30E−27 |
| EF100-2 | gi\|2058546 | ComYC [*Streptococcus gordonii*] | 193 | 7.30E−27 |
| EF100-2 | gi\|142708 | comG3 gene product [*Bacillus subtilis*]>gn1\|PID\|e1185739 comGC | 150 | 2.90E−22 |
| EF100-2 | gi\|142708 | comG3 gene product [*Bacillus subtilis*]>gn1\|PID\|e1185739 comGC | 150 | 2.90E−22 |
| EF100-2 | gi\|418437 | secretory component [*Erwinia chrysanthemi*]>pir\|E47021\|E47021 pectic | 134 | 4.40E−15 |
| EF100-2 | gi\|418437 | secretory component [*Erwinia chrysanthemi*]>pir\|E47021\|E47021 pectic | 134 | 4.40E−15 |
| EF100-2 | gi\|606262 | ORF_o145 [*Escherichia coli*]>gi\|693705 HopG [*Escherichia coli*] | 136 | 9.10E−13 |
| EF100-2 | gi\|606262 | ORF_o145 [*Escherichia coli*]>gi\|693705 HopG [*Escherichia coli*] | 136 | 9.10E−13 |
| EF100-2 | gi\|38828 | ExeG gene product [*Aeromonas hydrophia*]>pir\|S22910\|149905 protein | 132 | 3.50E−12 |
| EF100-2 | gi\|38828 | ExeG gene product [*Aeromonas hydrophia*]>pir\|S22910\|149905 protein | 132 | 3.50E−12 |
| EF100-2 | gn1\|PID\|e117259 | etpG [*Escherichia coli*] | 131 | 5.10E−12 |
| EF100-2 | gn1\|PID\|e117259 | etpG [*Escherichia coli*] | 131 | 5.10E−12 |
| EF100-2 | gi\|42189 | outG gene product [*Erwinia carotovora*]>pir\|S32861\|S32861 outG | 130 | 9.90E−12 |
| EF100-2 | gi\|42189 | outG gene product [*Erwinia carotovora*]>pir\|S32861\|S32861 outG | 130 | 9.90E−12 |
| EF100-2 | gi\|609628 | putative [*Vibrio cholerae*] | 128 | 1.60E−11 |
| EF100-2 | gi\|609628 | putative [*Vibrio cholerae*] | 128 | 1.60E−11 |
| EF101-2 | gn1\|PID\|d102573 | bacG [*Enterococcus faecalis*] | 106 | 3.60E−17 |
| EF101-2 | gn1\|PID\|e321943 | hypothetical protein [*Enterococcus faecalis*]>gn1\|PID\|e321943 | 105 | 1.80E−16 |
| EF101-2 | gn1\|PID\|e118502 | similar to hypothetical proteins from *B. subtilis* [Bacillus] | 113 | 1.80E−15 |
| EF110-2 | gi\|43338 | Staphylococcal serine proteinase homologue [*Enterococcus faecalis*] | 1462 | 2.30E−195 |
| EF110-2 | gn1\|PID\|d100108 | glutamic acid specific protease prepropeptide [Staphylococcus] | 106 | 3.70E−14 |
| EF110-2 | gi\|46687 | preproenzyme (AA −68 to 268) [*Staphylococcus aureus*] | 106 | 6.70E−14 |
| EF111-2 | gi\|606018 | ORF_o783 [*Escherichia coli*]>gi\|1789462 (AE000390) hypothetical 88.3 | 477 | 8.10E−80 |
| EF121-2 | gi\|2626826 | YfkN [*Bacillus subtilis*]>gn1\|PID\|e1182774 similar to | 143 | 1.30E−96 |
| EF121-2 | gi\|2313187 | (AE000532) 2',3'-cyclic-nucleotide 2'-phosphodiesterase (cpdB) | 413 | 2.60E−82 |
| EF121-2 | gi\|48453 | 5'-nucleotidase [*Vibrio parahaemolyticus*]>gn1\|PID\|d1001218 | 279 | 8.50E−47 |
| EF121-2 | gi\|757842 | UDP-sugar hydrolase [*Escherichia coli*] | 239 | 1.60E−44 |
| EF121-2 | gi\|1773162 | UDP-sugar hydrolase precursor [*Escherichia coli*]>gi\|1786687 | 239 | 1.60E−44 |
| EF121-2 | gi\|47950 | precursor polypeptide (AA −25 to 525) [*Salmonella typhimurium*] | 229 | 2.10E−41 |
| EF121-2 | gi\|747913 | 2',3'-cyclic-nucleotide 2'-phosphodiesterase [Yersinia] | 115 | 4.70E−36 |
| EF121-2 | gi\|62772 | 5'-nucleotidase [*Discopyge ommata*]>pir\|S19564\|S19564 5'-nucleotidase | 137 | 5.80E−35 |
| EF121-2 | gi\|1573573 | 2',3'-cyclic-nucleotide 2'-phosphodiesterase (cpdB) [Haemophilus] | 114 | 8.90E−34 |
| EF121-2 | gi\|537054 | 2',3'-cyclic-nucleotide 2'-phosphodiesterase [*Escherichia coli*] | 110 | 1.10E−31 |
| EF121-2 | bbs\|135915 | 5'-nucleotidase = glycosylphosphatidylinositol-anchored protein {EC} | 128 | 7.70E−29 |
| EF121-2 | gi\|1737443 | 5'-nucleotidase [*Boophilus microplus*] | 104 | 1.60E−28 |
| EF121-2 | gi\|202251 | 5'-nucleotidase precursor (EC 3.1.3.5) [*Rattus norvegicus*] | 138 | 6.10E−28 |
| EF121-2 | gi\|349783 | ecto-5'-nucleotidase [*Mus musculus*]>pir\|JC2001\|JC2001 | 136 | 1.10E−27 |
| EF121-2 | gi\|23897 | 5'-nucleotidase [*Homo sapiens*]>pir\|S11032\|S11032 5'-nucleotidase (EC) | 133 | 1.60E−27 |
| EF122-2 | gi\|2626826 | YfkN [*Bacillus subtilis*]>gn1\|PID\|e1182774 similar to | 143 | 1.30E−96 |
| EF122-2 | gi\|2313187 | (AE000532) 2',3'-cyclic-nucleotide 2'-phosphodiesterase (cpdB) | 413 | 2.60E−82 |
| EF122-2 | gi\|48453 | 5'-nucleotidase [*Vibrio parahaemolyticus*]>gn1\|PID\|d1001218 | 279 | 8.50E−47 |
| EF122-2 | gi\|757842 | UDP-sugar hydrolase [*Escherichia coli*] | 239 | 1.60E−44 |
| EF122-2 | gi\|1773162 | UDP-sugar hydrolase precursor [*Escherichia coli*]>gi\|1786687 | 239 | 1.60E−44 |
| EF122-2 | gi\|47950 | precursor polypeptide (AA −25 to 525) [*Salmonella typhimurium*] | 229 | 2.10E−41 |
| EF122-2 | gi\|747913 | 2',3'-cyclic-nucleotide 2'-phosphodiesterase [Yersinia] | 115 | 4.70E−36 |
| EF122-2 | gi\|62772 | 5'-nucleotidase [*Discopyge ommata*]>pir\|S19564\|S19564 5'-nucleotidase | 137 | 5.80E−35 |
| EF122-2 | gi\|1573573 | 2',3'-cyclic-nucleotide 2'-phosphodiesterase (cpdB) [Haemophilus] | 114 | 8.90E−34 |
| EF122-2 | gi\|537054 | 2',3'-cyclic-nucleotide 2'-phosphodiesterase [*Escherichia coli*] | 110 | 1.10E−31 |
| EF122-2 | bbs\|135915 | 5'-nucleotidase = glycosylphosphatidylinositol-anchored protein {EC} | 128 | 7.70E−29 |
| EF122-2 | gi\|1737443 | 5'-nucleotidase [*Boophilus microplus*] | 104 | 1.60E−28 |
| EF122-2 | gi\|202551 | 5'-nucleotidase precursor (EC 3.1.3.4) [*Rattus norvegicus*] | 138 | 6.10E−28 |
| EF122-2 | gi\|349783 | ecto-5'-nucleotidase [*Mus musculus*]>pir\|JC2001\|JC2001 | 136 | 1.10E−27 |
| EF122-2 | gi\|23897 | 5'-nucleotidase [*Homo sapiens*]>pir\|S11032\|S11032 5'-nucleotidase (EC) | 133 | 1.60E−27 |
| EF129-2 | gi\|43334 | P54 protein [*Enterococcus faecium*]>pir\|S05542\|S05542 hypothetical | 630 | 9.40E−79 |
| EF129-2 | gi\|512521 | usp 45 gene product [*Lactococcus lactis*]>pir\|JN0097\|JN0097 secreted | 374 | 1.30E−42 |
| EF129-2 | gi\|149525 | secreted protein [*Lactococcus lactis*] | 371 | 3.60E−42 |
| EF129-2 | gn1\|PID\|e313022 | hypothetical protein [*Bacillus subtilis*]>gn1\|PID\|e1186168 | 317 | 2.30E−33 |
| EF130-2 | gi\|488339 | alpha-amylase [unidentified cloning vector] | 621 | 6.70E−81 |
| EF130-2 | gi\|488336 | ORF [unidentified cloning vector] | 242 | 8.00E−27 |
| EF130-2 | bbs\|112518 | alpha-amylase {N-terminal region} [Artificial sequence, Peptide] | 237 | 4.80E−26 |
| EF130-2 | gn1\|PID\|e289144 | ywpE [*Bacillus subtilis*]>gn1\|PID\|e1184540 ywpE [Bacillus] | 129 | 5.40E−11 |
| EF131-2 | gn1\|PID\|e118528 | penicillin-binding protein [*Bacillus subtilis*] | 277 | 7.40E−43 |
| EF131-2 | gi\|488330 | alpha-amylase [unidentified cloning vector] | 280 | 1.30E−31 |
| EF131-2 | gi\|509249 | No definition line found [*Lactobacillus plantarum*] | 274 | 1.10E−30 |
| EF131-2 | gn1\|PID\|d102491 | (AB009635) Fmt [*Staphylococcus aureus*] | 170 | 5.60E−20 |
| EF131-2 | gi\|515050 | DD-peptidase precursor [*Streptomyces lividans*]>pir\|S48220\|S48220 | 131 | 2.30E−14 |
| EF131-2 | gi\|153448 | serine DD-peptide [*Streptomyces lividans*] | 131 | 1.20E−12 |
| EF132-2 | gi\|153826 | adhesin B [*Streptococcus sanguis*]>pir\|A43583\|A43583 adhesin B | 1257 | 2.30E−166 |
| EF132-2 | gi\|1184932 | ScbA [*Streptococcus crista*] | 1248 | 3.70E−165 |
| EF132-2 | gi\|310633 | adhesin [*Streptococcus gordonii*] | 1247 | 5.10E−165 |
| EF132-2 | gi\|393269 | adhesion protein [*Streptococcus pneumoniae*] | 1204 | 3.40E−163 |
| EF132-2 | gi\|1575030 | surface adhesin A precursor [*Streptococcus pneumoniae*] | 1220 | 2.40E−161 |
| EF132-2 | gi\|153834 | adhesin specific for salivary pellicle of dental surfaces | 1203 | 4.80E−159 |
| EF132-2 | gi\|1117994 | surface antigen A variant precursor [*Streptococcus pneumoniae*] | 1191 | 2.00E−157 |

TABLE 2-continued

Closest matching sequences between the polypeptides of the present invention and sequences in GenBank and Derwent databases.

| Query | | Description | | |
|---|---|---|---|---|
| EF132-2 | gi|493017 | endocarditis specific antigen [*Enterococcus faecalis*] | 931 | 3.70E−122 |
| EF132-2 | gnl|PID|e255529 | lipoprotein [*Staphylococcus epidermidis*] | 453 | 3.20E−92 |
| EF132-2 | gi|1245464 | YfeA [*Yersinia pestis*]>gi|1245464 YfeA [*Yersinia pestis*] | 364 | 3.60E−64 |
| EF132-2 | gi|1573330 | adhesin B precursor (fimA) [*Haemophilus influenzae*] | 349 | 3.50E−63 |
| EF132-2 | gi|755075 | periplasmic-binding protein [Synechocystis sp.]>gnl|PID|d1018652 Mn | 326 | 6.80E−62 |
| EF132-2 | gnl|PID|e118595 | similar to ABC transporter (membrane protein) [Bacillus] | 174 | 3.10E−32 |
| EF132-2 | gi|1777933 | TroA [*Treponema pallidum*] | 171 | 3.40E−32 |
| EF132-2 | gi|790546 | Tromp1 [*Treponema pallidum*] | 171 | 5.10E−32 |

| Query | Derwent Access. No. | Derwent Gene Description | BLAST Score | BLAST P-Value |
|---|---|---|---|---|
| EF003-2 | W20909 | *H. pylori* outer membrane protein 14ge 10705orf5. | 268 | 4.20E−39 |
| EF003-2 | W20166 | *Helicobacter pylori* outer membrane protein, 16225006.aa. | 241 | 3.00E−27 |
| EF006-2 | W20909 | *H. pylori* outer membrane protein 14ge10705orf5. | 283 | 1.20E−48 |
| EF006-2 | W20166 | *Helicobacter pylori* outer membrane protein, 16225006.aa. | 266 | 1.10E−30 |
| EF008-2 | R37495 | Pneumococcal fimbrial protein A | 967 | 1.20E−127 |
| EF008-2 | W26367 | *Staphylococcus aureus* saliva binding protein. | 467 | 7.50E−100 |
| EF008-2 | R79722 | ROM precursor TROMP1. | 181 | 8.00E−36 |
| EF008-2 | W22134 | *Treponema pallidum* rare outer membrane protein (TROMP-1). | 181 | 8.00E−36 |
| EF009-2 | W20909 | *H. pylori* outer membrane protein 14ge10705orf5. | 319 | 1.40E−53 |
| EF009-2 | W20166 | *Helicobacter pylori* outer membrane protein, 16225006.aa. | 278 | 2.50E−32 |
| EF012-2 | R48035 | Hyaluronic acid synthase of *Streptococcus equisimilis*. | 227 | 3.20E−69 |
| EF014-2 | W14070 | *S. thermophilus* exopolysaccharide biosynthesis protein EpsR. | 103 | 5.90E−19 |
| EF014-2 | W22169 | *S. thermophilus* exopolysaccharide synthesis operon epsA gene product | 103 | 7.30E−18 |
| EF016-2 | W15799 | Adherence factor 104R of *Lactobacillus fermemtum*. | 157 | 9.60E−22 |
| EF016-2 | W15793 | Adherence factor consensus sequence. | 103 | 1.00E−11 |
| EF017-2 | R48035 | Hyaluronic acid synthase of *Streptococcus equisimilis*. | 241 | 8.90E−71 |
| EF021-2 | R31013 | P39-alpha. | 141 | 1.60E−19 |
| EF021-2 | R33280 | P39-beta. | 134 | 7.00E−14 |
| EF022-2 | R48035 | Hyaluronic acid synthase of *Streptococcus equisimilis*. | 324 | 2.20E−65 |
| EF023-2 | R48035 | Hyaluronic acis synthase of *Streptococcus equisimilis*. | 155 | 9.90E−33 |
| EF023-2 | R70152 | *Streptococcus pneumoniae* strain SPRU98 PlpA. | 125 | 5.90E−17 |
| EF027-2 | R48035 | Hyaluronic acid synthase of *Streptococcus equisimilis*. | 233 | 2.20E−34 |
| EF028-2 | W17830 | Thermophilic alkaline phosphatase. | 202 | 7.70E−59 |
| EF028-2 | W11568 | *E. coli* alkaline phosphatase mutant D153H/Q329A. | 182 | 7.90E−56 |
| EF028-2 | W11570 | *E. coli* alkaline phosphatase mutant D153H/K328H/Q329A. | 182 | 7.90E−56 |
| EF028-2 | W26300 | *E. coli* alkaline phosphatase mutant D153H/K328H/Q329A/D330H. | 182 | 1.10E−55 |
| EF028-2 | W11565 | *E. coli* alkaline phosphatase mutant D153H/K328H/D330A. | 182 | 3.10E−55 |
| EF028-2 | W11557 | *E. coli* alkaline phosphatase mutant D153H/D330N. | 182 | 4.30E−55 |
| EF028-2 | W11561 | *E. coli* alkaline phosphatase mutant D153H/D330A. | 182 | 4.30E−55 |
| EF028-2 | W11555 | *E. coli* alkaline phosphatase mutant D153H/K328H/D330N. | 182 | 4.70E−55 |
| EF028-2 | W11566 | *E. coli* alkaline phosphatase mutant D153H/K328H/D330L. | 182 | 1.20E−54 |
| EF028-2 | W11569 | *E. coli* alkaline phosphatase mutant K328H/Q329A. | 180 | 1.70E−54 |
| EF028-2 | W11562 | *E. coli* alkaline phosphatase mutant D153H/D330L. | 182 | 1.70E−54 |
| EF028-2 | R26980 | Fv(FRP5)-phoA recombinant antibody. | 174 | 1.90E−54 |
| EF028-2 | W11567 | *E. coli* alkaline phosphatase mutant Q329A. | 179 | 2.30E−54 |
| EF028-2 | W11558 | *E. coli* alkaline phosphatase mutant K328H/D330N. | 176 | 6.40E−54 |
| EF028-2 | W11563 | *E. coli* alkaline phosphatase mutant K328H/D330A. | 176 | 6.40E−54 |
| EF029-2 | R10044 | Plasmid pOW360 encoded Human Growth Hormone (HGH) - nuclease A | 320 | 3.50E−40 |
| EF029-2 | R10041 | Plasmid pOW350 nuclease A product. | 320 | 4.30E−40 |
| EF029-2 | R73997 | *Staphylococcus aureus* (Foggi) nuclease signal and mature sequences. | 320 | 5.60E−40 |
| EF029-2 | R10043 | Plasmid pOW360 encoding Human Growth Hormone (HGH) - nuclease | 320 | 2.90E−38 |
| EF030-2 | R48035 | Hyaluronic acid synthase of *Streptococcus equisimilis*. | 277 | 6.10E−47 |
| EF040-2 | R59077 | 2-5A-dependent RNA-ase. | 105 | 1.90E−18 |
| EF040-2 | W12703 | Mouse 2-5A-dependent RNase. | 105 | 1.90E−18 |
| EF040-2 | R82661 | Partial murine 2-5A-dependent RNase. | 105 | 1.90E−18 |
| EF041-2 | R48035 | Hyaluronic acid synthase of *Streptococcus equisimilis*. | 225 | 6.30E−26 |
| EF054-2 | R26042 | *P. yoelii* SSP2 antigen. | 286 | 8.00E−34 |
| EF054-2 | R85782 | Group B Streptococcal mutant beta antigen without IgA binding domain. | 232 | 3.30E−24 |
| EF054-2 | R85781 | Group B Streptococcal wild-type beta antigen. | 232 | 5.20E−24 |
| EF054-2 | P91941 | Sequence of preprospasmolysin. | 204 | 3.10E−19 |
| EF054-2 | W32519 | Collagen-like polypeptide SEQ ID NO: 2. | 180 | 7.50E−18 |
| EF054-2 | W12324 | Silver halide emulsion protein monomeric repeat unit #2. | 180 | 7.50E−18 |
| EF054-2 | W32522 | Collagen-like polypeptide SEQ ID NO: 5. | 192 | 1.60E−17 |
| EF054-2 | W12327 | Silver halide emulsion protein monomeric repeat unit #5. | 192 | 1.60E−17 |
| EF054-2 | W32520 | Collagen-like polypeptide SEQ ID NO: 3. | 189 | 2.40E−17 |
| EF054-2 | W32532 | Collagen-like polypeptide SEQ ID NO: 15. | 189 | 2.40E−17 |
| EF054-2 | W12325 | Silver halide emulsion protein monomeric repeat unit #3. | 189 | 2.40E−17 |
| EF054-2 | W12337 | Silver halide emulsion protein monomeric repeat unit #15. | 189 | 2.40E−17 |
| EF054-2 | W12341 | Silver halide emulsion FLAG(RTM)-tagged protein #2. | 189 | 2.60E−17 |
| EF054-2 | W02098 | *S. mutans* antigen I/II. | 161 | 5.40E−15 |
| EF054-2 | W02096 | *S. mutans* antigen I/II fragment (aa803–1114). | 161 | 1.90E−13 |
| EF059-2 | R26042 | *P. yoelii* SSP2 antigen. | 344 | 1.90E−39 |
| EF059-2 | R85782 | Group B Streptococcal mutant beta antigent without IgA binding domain. | 232 | 1.10E−26 |
| EF059-2 | R85781 | Group B Streptococcal wild-type beta antigen. | 232 | 1.70E−26 |
| EF059-2 | P91941 | Sequence of preprospasmolysin. | 200 | 1.50E−18 |

TABLE 2-continued

Closest matching sequences between the polypeptides of the present invention and sequences in GenBank and Derwent databases.

| | | | | |
|---|---|---|---|---|
| EF059-2 | P60570 | Sequence of the Falciparum Interspersed Repeat Antigen | 186 | 4.60E−18 |
| EF059-2 | W02096 | *S. mutans* antigen I/II fragment (aa803–1114). | 167 | 8.20E−16 |
| EF059-2 | W02098 | *S. mutans* antigen I/II. | 167 | 4.90E−15 |
| EF059-2 | R79625 | Endocarditis specific antigen region. | 147 | 4.40E−12 |
| EF059-2 | R26049 | MSF precursor. | 143 | 1.30E−11 |
| EF059-2 | R28150 | Sugar beet chitinase 1. | 148 | 1.70E−11 |
| EF059-2 | R26842 | Protease from *S. Aureus* ATCC12600. | 147 | 2.10E−11 |
| EF059-2 | R79643 | Immunodominant antigen of *Streptococcus sobrinus*. | 151 | 2.10E−11 |
| EF059-2 | W07539 | Collagen like protein (CLP). | 146 | 3.00E−11 |
| EF061-2 | R26042 | *P. yoelii* SSP2 antigen. | 241 | 1.70E−25 |
| EF061-2 | P60570 | Sequence of the Falciparum Interspersed Repeat Antigen | 199 | 1.60E−18 |
| EF061-2 | R85782 | Group B Streptococcal mutant beta antigen without IgA binding domain. | 153 | 2.40E−14 |
| EF061-2 | R85781 | Group B Streptococcal wild-type beta antigen. | 153 | 3.60E−14 |
| EF061-2 | P91941 | Sequence of preprospasmolysin. | 163 | 9.70E−14 |
| EF061-2 | P83194 | Sequence of a bioadhesive precursor protein encoded by cDNA clone | 156 | 7.90E−13 |
| EF061-2 | R28150 | Sugar beet chitinase 1. | 156 | 9.10E−13 |
| EF061-2 | W02096 | *S. mutans* antigen I/II fragment (aa803–1114). | 148 | 1.20E−12 |
| EF061-2 | P82971 | Bioadhesive precursor protein from cDNA 52. | 148 | 9.70E−12 |
| EF061-2 | W02098 | *S. mutans* antigen I/II. | 148 | 1.50E−11 |
| EF061-2 | W02098 | *S. mutans* antigen I/II. | 107 | 1.20E−36 |
| EF062-2 | R79643 | Immunodominant antigen of *Streptococcus sobrinus*. | 132 | 3.00E−36 |
| EF063-2 | W02098 | *S. mutans* antigen I/II. | 107 | 1.20E−36 |
| EF063-2 | R79643 | Immunodominant antigen of *Streptococcus sobrinus*. | 132 | 3.00E−36 |
| EF064-2 | W02098 | *S. mutans* antigen I/II. | 107 | 1.20E−36 |
| EF064-2 | R79643 | Immunodominant antigen of *Streptococcus sobrinus*. | 132 | 3.00E−36 |
| EF071-2 | R85294 | Phage R1-t LytR lysin. | 127 | 3.70E−38 |
| EF071-2 | R91515 | Listeria phage lysin PLY511. | 273 | 4.70E−37 |
| EF075-2 | W14070 | *S. thermophilus* exopolysaccharide biosynthesis protein EpsR. | 239 | 4.20E−36 |
| EF075-2 | W22169 | *S. thermophilus* exopolysaccharide synthesis operon epsA gene product. | 239 | 4.00E−34 |
| EF077-2 | R97280 | Helicobacter-specific ATPase 439. | 258 | 4.10E−74 |
| EF077-2 | R48036 | Mycobacterium BCG immunogen. | 192 | 2.20E−67 |
| EF077-2 | W06712 | Helicobacter-specific ATPase 948 (ORF-4). | 220 | 2.50E−67 |
| EF077-2 | R70419 | Rat homologue of human Wilson disease gene ATP7B. | 186 | 9.80E−54 |
| EF077-2 | R72343 | Wilson disease protein ATP7B. | 176 | 6.70E−40 |
| EF077-2 | R06376 | Product of the ssc1 gene. | 166 | 3.10E−28 |
| EF077-2 | R75396 | Flea sodium pump alpha subunit. | 146 | 2.40E−25 |
| EF077-2 | W20891 | *H. pylori* transporter protein, 14ce20219orf1. | 156 | 8.60E−14 |
| EF078-2 | R56667 | *Bacteroides fragilis* RprX regulatory response protein. | 148 | 8.30E−18 |
| EF078-2 | R74630 | Tomato TGETR1 ethylene response protein. | 130 | 7.80E−13 |
| EF078-2 | R69849 | Ethylene response (ETR) gene product. | 128 | 1.70E−11 |
| EF078-2 | R69850 | Ethylene response (ETR) mutant protein etrl-1. | 128 | 1.70E−11 |
| EF078-2 | R69851 | Ethylene response (ETR) mutant protein etrl-2. | 128 | 1.70E−11 |
| EF078-2 | R69852 | Ethylene response (ETR) mutant protein etrl-3. | 128 | 1.70E−11 |
| EF078-2 | R69853 | Ethylene response (ETR) mutant protein etrl-4. | 128 | 1.70E−11 |
| EF078-2 | R24296 | Regulatory protein VanS involved in glycopeptide resistance. | 142 | 2.70E−11 |
| EF081-2 | R27253 | Penicillin binding protein PBP2A-epi. | 101 | 4.70E−16 |
| EF081-2 | R27256 | Penicillin binding protein PBP2A-27R. | 101 | 6.00E−15 |
| EF081-2 | R27257 | Penicillin binding protein derivative #1. | 101 | 6.20E−15 |
| EF081-2 | R27258 | Penicillin binding protein derivative #2. | 101 | 6.20E−15 |
| EF081-2 | R27259 | Penicillin binding protein derivative #3. | 101 | 6.20E−15 |
| EF081-2 | R27260 | Penicillin binding protein derivative #4. | 101 | 6.20E−15 |
| EF081-2 | R27261 | Penicillin binding protein derivative #5. | 101 | 6.20E−15 |
| EF081-2 | R27262 | Penicillin binding protein derivative #7. | 101 | 6.20E−15 |
| EF081-2 | R27264 | Penicillin binding protein derivative #8. | 101 | 6.20E−15 |
| EF081-2 | R27262 | Penicillin binding protein derivative #6. | 101 | 6.20E−15 |
| EF081-2 | R30845 | Sequence encoded by the mec A gene. | 101 | 6.90E−15 |
| EF081-2 | R27255 | Penicillin binding protein PBP2A-27R. | 101 | 6.90E−15 |
| EF081-2 | R31216 | Penicillin binding protein PBP2A-27R. | 101 | 7.00E−15 |
| EF110-2 | R91042 | V8 mature protease (aa1–213). | 106 | 6.60E−16 |
| EF110-2 | R91043 | V8 mature protease (aa1–214). | 106 | 7.20E−16 |
| EF110-2 | R91044 | V8 mature protease (aa1–215). | 106 | 7.80E−16 |
| EF110-2 | R26842 | Protease from *S. Aureus* ATCC12600. | 106 | 6.70E−15 |
| EF110-2 | R29644 | Protease from *S. Aureus*. | 106 | 1.20E−14 |
| EF110-2 | W22218 | Protein encoded by pV8RPT(−) construct. | 106 | 7.60E−14 |
| EF110-2 | R91033 | Beta-galactosidase-V8 protease fusion protein. | 106 | 7.60E−14 |
| EF110-2 | R91034 | Beta-galactosidase-V8 protease fusion protein. | 106 | 1.70E−13 |
| EF110-2 | W22219 | Protein encoded by pV8D construct. | 106 | 7.60E−13 |
| EF110-2 | R91035 | Recombinant V8 protease V8D fusion protein. | 106 | 7.60E−13 |
| EF110-2 | W22220 | Protein eoncoded by pV8F construct. | 106 | 7.90E−13 |
| EF129-2 | R14530 | Usp45 protein. | 374 | 2.40E−43 |
| EF129-2 | R14150 | MSP encoded by pUCRS (DSM 5803). | 372 | 4.70E−43 |
| EF131-2 | R37495 | *Pneumococcal fimbrial* protein A. | 1185 | 6.80E−163 |
| EF131-2 | W26367 | *Staphylococcus aureus* saliva binding protein. | 418 | 3.70E−85 |
| EF131-2 | R79722 | ROM precursor TROMP1. | 171 | 9.00E−31 |
| EF131-2 | W22134 | *Treponema pallidum* rare outer membraine protein (TROMP-1). | 171 | 9.00E−31 |

TABLE 3

Conservative Amino Acid Substitutions.

| | |
|---|---|
| Aromatic | Phenylalanine |
| | Tryptophan |
| | Tyrosine |
| Hydrophobic | Leucine |
| | Isoleucine |
| | Valine |
| Polar | Glutamine |
| | Asparagine |

TABLE 3-continued

Conservative Amino Acid Substitutions.

| | |
|---|---|
| Basic | Arginine |
| | Lysine |
| | Histidine |
| Acidic | Aspartic Acid |
| | Glutamic Acid |
| Small | Alanine |
| | Serine |
| | Threonine |
| | Methionine |
| | Glycine |

TABLE 4

Residues Comprising Antigenic Epitope-Bearing Portion.

| | |
|---|---|
| EF001-2 | from about Asp-150 to about Lys-152, from about Ser-256 to about Tyr-259, from about Lys-360 to about Lys-363, from about Asn-406 to about Asp-408. |
| EF002-2 | from about Asp-80 to about Asp-83, from about Asp-281 to about Gly-283. |
| EF003-2 | from about Asn-263 to about Gly-266. |
| EF004-2 | from about Asn-23 to about Asn-26, from about Lys-83 to about Ser-87, from about Tyr-154 to about Asp-159. |
| EF005-2 | from about Lys-249 to about Glu-252. |
| EF006-2 | from about Gly-23 to about Asp-28. |
| EF008-2 | from about Thr-92 to about Gly-94, from about Pro-161 to about Asp-165, from about Gly-287 to about Thr-289. |
| EF010-2 | from about Pro-129 to about Asn-131. |
| EF012-2 | from about Asp-77 to about Asp-79, from about Asp-94 to about Lys-98, from about Asp-256 to about Thr-258, from about Glu-461 to about Asn-468. |
| EF013-2 | from about Thr-30 to about Asp-32, from about Glu-73 to about Ala-75, from about Gln-164 to about Asn-166, from about Lys-193 to about Gly-195. |
| EF014-2 | from about Ser-203 to about Asp-206, from about Gln-314 to about Gly-316 |
| EF015-2 | from about Pro-66 to about Gly-69. |
| EF016-2 | from about Lys-236 to about Asn-239. |
| EF017-2 | from about Ser-90 to about Gly-93, from about Thr-197 to about Lys-199, from about Lys-230 to about Asn-233, from about Ser-428 to about Gly-431. |
| EF018-2 | from about Lys-159 to about Tyr-161, from about Asn-165 to about Ser-167, from about Asn-250 to about Arg-256, from about Asn-392 to about Gly-395, from about Lys-416 to about Tyr-418, from about Asn-428 to about Arg-430. |
| EF019-2 | from about Arg-209 to about Ser-211, from about Lys-287 to about Ser-290. |
| EF020-2 | from about Lys-57 to about Asn-62. |
| EF021-2 | from about Ser-33 to about Gly-35, from about Glu-77 to about Gly-81, from about Asp-139 to about Lys-141, from about Glu-255 to about Ser-258, from about Gln-271 to about Tyr-277. |
| EF023-2 | from about Lys-232 to about Asp-234, from about Arg-304 to about Gly-306, from about Thr-453 to about Arg-456, from about Ser-478 to about Thr-480. |
| EF025-2 | from about Ar-183 to about As-185. |
| EF026-2 | from about Ser-25 to about Asp-30, from about Asp-90 to about Asp-94, from about Gln-107 to about Asn-110. |
| EF027-2 | from about Gln-72 to about Lys-74, from about Lys-229 to about Asp-231. |
| EF028-2 | from about Asp-186 to about Gln-188. |
| EF029-2 | from about Asp-118 to about Lys-122, from about Asp-124 to about Tyr-126. |
| EF031-2 | from about Glu-30 to about Gly-33. |
| EF034-2 | from about Glu-25 to about Gly-27, from about Glu-75 to about Thr-77. |
| EF36-2 | from about Gln-177 to about Ser-179. |
| EF037-2 | from about Ser-25 to about Asp-30, from about Asp-90 to about Asp-94, from about Gln-107 to about Asn-110. |
| EF038-2 | from about Asn-77 to about Lys-79, from about Tyr-88 to about Asn-92. |

TABLE 4-continued

| | Residues Comprising Antigenic Epitope-Bearing Portion. |
|---|---|
| EF040-2 | from about Lys-167 to about Gly-172, from about Lys-240 to about Asn-242. |
| EF044-2 | from about Arg-192 to about Gly-194, from about Asn-200 to about Asn-203. |
| EF045-2 | from about Asp-159 to about Asn-161, from about His-172 to about Gly-174, from about Tyr-261 to about Gly-264, from about Lys-305 to about Glu-308. |
| EF046-2 | from about Ser-18 to about Gly-23, from about Gln-41 to about Ser-47, from about Thr-76 to about Asp-78. |
| EF047-2 | from about Asn-28 to about Asp-30, from about Asp-273 to about Asn-277. |
| EF048-2 | from about Asp-138 to about Lys-141, from about Asp-152 to about Gly-154. |
| EF051-2 | from about Asp-73 to about Gly-76. |
| EF053-2 | from about Ser-79 to about Gly-82. |
| EF055-2 | from about Asp-26 to about Gly-28, from about Gln-67 to about Asp-69, from about Arg-71 to about Gly-74, from about Arg-87 to about Gly-89. |
| EF056-2 | from about Arg-71 to about Gly-74, from about Arg-87 to about Gly-89. |
| EF058-2 | from about Lys-129 to about Gly-133, from about Gln-571 to about Tyr-573, from about Pro-586 to about Gly-591. |
| EF065-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |
| EF066-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |
| EF067-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |
| EF073-2 | from about Met-98 to about Arg-100, from about Arg-110 to about Asp-112. |
| EF074-2 | from about Ser-53 to about Tyr-59, from about Ser-86 to about Gly-88, from about Pro-97 to about Gln-100, from about Gln-230 to about Gly-232. |
| EF076-2 | from about Asn-38 to about Tyr-40, from about Asp-48 to about Asn-53, from about Lys-79 to about Gly-81. |
| EF077-2 | from about Arg-411 to about Gly-413. |
| EF078-2 | from about Thr-294 to about Gly-296, from about Asp-366 to about Gln-368, from about Glu-524 to about Gly-526. |
| EF080-2 | from about Glu-164 to about Gly-166, from about Ser-206 to about Tyr-208, from about Lys-239 to about Gly-243. |
| EF081-2 | from about Asn-7 to about Ser-11, from about Lys-77 to about Tyr-80, from about Lys-112 to about Asn-114, from about Gly-162 to about Asp-164, from about Arg-181 to about Gly-183. |
| EF083-2 | from about Gln-38 to about Arg-40. |
| EF084-2 | from about Lys-140 to about Asp-142, from about Gly-164 to about Arg-166, from about Arg-262 to about Gly-264. |
| EF085-2 | from about Asn-95 to about Asp-97, from about Arg-112 to about Asp-114, from about Asp-258 to about Ser-260, from about Arg-401 to about Ser-403. |
| EF086-2 | from about Pro-112 to about Gly-115, from about Ser-222 to about Ser-224, from about Asn-296 to about Gly-299, from about Thr-346 to about Lys-348, from about Asp-428 to about Ser-432. |
| EF087-2 | from about Pro-112 to about Gly-115, from about Ser-222 to about Ser-224, from about Asn-296 to about Gly-299, from about Thr-346 to about Lys-348, from about Asp-428 to about Ser-432. |
| EF088-2 | from about Pro-112 to about Gly-115, from about Ser-222 to about Ser-224, from about Asn-296 to about Gly-299, from about Thr-346 to about Lys-348, from about Asp-428 to about Ser-432. |
| EF090-2 | from about Arg-2 to about Arg-5. |
| EF091-2 | from about Gln-40 to about Asp-43. |
| EF093-2 | from about Lys-95 to about Gly-97. |
| EF094-2 | from about Asp-314 to about Asp-316. |
| EF095-2 | from about Ser-328 to about Thr-330, from about Asp-359 to about Asp-363, from about Glu-637 to about Gly-639, from about Asn-744 to about Gly-746. |
| EF096-2 | from about Pro-128 to about Asn-130, from about Ser-193 to about Asp-196. |
| EF097-2 | from about Val-357 to about Gly-359. |
| EF099-2 | from about Glu-44 to about Asp-47, from about Lys-154 to about Gly-156, from about Asn-286 to about Asp-289. |
| EF101-2 | from about Lys-40 to about Asp-42, from about Pro-255 to about Asn-258, from about Lys-288 to about Gly-290. |
| EF102-2 | from about Asp-314 to about Asp-316. |

TABLE 4-continued

| | Residues Comprising Antigenic Epitope-Bearing Portion. |
|---|---|
| EF103-2 | from about Asn-46 to about Gly-48. |
| EF104-2 | from about Pro-232 to about Lys-237, from about Ala-362 to about Asn-366, from about Ser-421 to about Gly-423, from about Lys-488 to about Ser-490, from about Asp-550 to about Asn-552, from about Pro-637 to about Lys-640, from about Asp-727 to about Gly-729, from about Asn-751 to about Ser-754, from about Lys-771 to about Asn-774, from about Ile-835 to about Asn-837, from about Pro-851 to about Gly-853. |
| EF105-2 | from about Ser-40 to about Gly-43, from about Asn-94 to about Gln-97, from about Gln-220 to about Gly-222, from about Asn-263 to about Gly-265. |
| EF106-2 | from about Asp-72 to about Gly-75, from about Thr-274 to about Asp-277, from about Asn-310 to about Arg-313. |
| EF107-2 | from about Thr-155 to about Asn-157, from about Thr-189 to about Asp-191, from about Arg-270 to about Gly-272, from about Thr-330 to about Lys-335, from about Asp-365 to about Asp-368, from about Pro-451 to about Asp-453, from about Gly-485 to about Thr-488. |
| EF108-2 | from about Lys-142 to about Trp-145, from about Thr-147 to about Tyr-150, from about Arg-212 to about Gly-214, from about Ser-248 to about Asp-251, from about Asp-384 to about Asp-387, from about Pro-481 to about Arg-483, from about Lys-491 to about Gly-494, from about Thr-619 to about Gly-624, from about Asp-656 to about Asp-659, from about Lys-717 to about Asn-721, from about Ser-822 to about Gly-824, from about Tyr-1137 to about Thr-1141. |
| EF110-2 | from about Pro-123 to about Gly-127, from about Thr-223 to about Gly-225. |
| EF111-2 | from about Lys-207 to about Asn-209, from about Asp-245 to about Asn-248, from about Lys-396 to about Asp-398, from about Glu-429 to about Ser-432, from about Thr-470 to about His-474. |
| EF119-2 | from about Asp-90 to about Asn-92, from about Gln-142 to about Gly-144. |
| EF121-2 | from about Asn-159 to about Asp-161, from about Asn-351 to about Lys-353, from about Pro-658 to about Gly-660, from about Lys-786 to about Ser-789. |
| EF122-2 | from about Asn-159 to about Asp-161, from about Asn-351 to about Lys-353, from about Pro-658 to about Gly-660, from about Lys-786 to about Ser-789. |
| EF123-2 | from about Asn-331 to about Arg-336, from about Asp-634 to about Gly-636, from about Glu-780 to about Ser-782, from about Tyr-909 to about Asn-911, from about Lys-939 to about Glu-942, from about Asp-1074 to about Gly-1076, from about Asp-1367 to about Gly-1369, from about Pro-1433 to about Lys-1435, from about Gly-1516 to about Asp-1518, from about Lys-1656 to about Asp-1660, from about Lys-1860 to about Gln-1863, from about Ser-1916 to about Gln-1919, from about Pro-1940 to about Gly-1942. |
| EF124-2 | from about Asn-331 to about Arg-336, from about Asp-634 to about Gly-636, from about Glu-780 to about Ser-782, from about Tyr-909 to about Asn-911, from about Lys-939 to about Glu-942, from about Asp-1074 to about Gly-1076, from about Asp-1367 to about Gly-1369, from about Pro-1433 to about Lys-1435, from about Gly-1516 to about Asp-1518, from about Lys-1656 to about Asp-1660, from about Lys-1860 to about Gln-1863, from about Ser-1916 to about Gln-1919, from about Pro-1940 to about Gly-1942. |
| EF125-2 | from about Asn-331 to about Arg-336, from about Asp-634 to about Gly-636, from about Glu-780 to about Ser-782, from about Tyr-909 to about Asn-911, from about Lys-939 to about Glu-942, from about Asp-1074 to about Gly-1076, from about Asp-1367 to about Gly-1369, from about Pro-1433 to about Lys-1435, from about Gly-1516 to about Asp-1518, from about Lys-1656 to about Asp-1660, from about Lys-1860 to about Gln-1863, from about Ser-1916 to about Gln-1919, from about Pro-1940 to about Gly-1942. |
| EF126-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |
| EF127-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |
| EF128-2 | from about Ser-236 to about Tyr-239, from about Asp-350 to about Gly-352, from about Lys-415 to about Asn-418, from about Arg-446 to about Asp-448, from about Asn-489 to about Lys-491, from about Ser-516 to about Asp-518, from about Glu-639 to about Lys-642. |

TABLE 4-continued

Residues Comprising Antigenic Epitope-Bearing Portion.

| | |
|---|---|
| EF129-2 | from about Asn-300 to about Gly-302, from about Ser-316 to about Gly-319, from about Asn-385 to about His-387 |
| EF131-2 | from about Lys-201 to about Tyr-204, from about Glu-263 to about Ser-266. |
| EF132-2 | from about Thr-26 to about Ser-28. |

SEQUENCE LISTING (496 sequences)

SEQ ID NO: 1 - DNA, 1347 bp; double-stranded, linear
tgaaagaatattgccagaacgtggcgagcaaattgttttataaatttttttaagggagagaaaaaaatgaagttcaaaactctagcaacaacagtgttagcaaccgcagctattttcgcattgggggcttgtggtaacggtaatggggccaaagaatcaaacgatattgtgaaagaagtgaaggaagatacgacaatcactttctggcatgcaatgaatggggttcaagaagaagcgttaacaaaattaacgaaagacttcatgaaagaaaatccaaaaattaaagtggaattacaaaatcaatctgcttaccctgatttacaagccaaaatcaattcgactttaacttcaccaaaagatttaccaacaattacgcaagcgtacccaggctggttatggaatgctgcacaagatgaaatgttagtggacttaaaaccatatatggatgatgacacaatcggctggaaagatgcagagccaattcgtgaagtattgttagacggcgccaaaatcgacggcaaacaatacggcattccatttaataaatcgacagaaatgttattctataatgctgatttgttgaaagaatatggtgttgaagtaccgaaaacattagaggaattaaaagaagcttctaaaacaatttacgaaaaatccaacaaagaagtcgttggtgctggttttgactcgttaaataactattacgcaattggaatgaaaaacaaaggcgttgattttaataaagacttagatttaacaagcaaagattcacaagaagtcgtggactattaccgtgatggtatcgaagcaggttacttccgcacagctggttcagataaatatttatctggcccatttgcaaacaaaaaggtagcaatgtttgtcggtagtattgctggtgctggttttgttcaaaaagatgctgaagctggtggctatgaatacggtgttgcaccacgtcctgaaaaaatcaacttacaacaaggaacagatatttatatgttcgatagtgctacgccagaacaacggacagcggcatttgaattcatgaaattcttagctactcctgattcacaattgtactgggcacaacaaacaggttatatgccaattttagaatctgttttacacagtgatgagtacaaaaattctaagacaaccaaagtacctgcacaacttgaaaacgcagtaaaagatttattcgctatcccagtagaagaaaatgctgattcagcctataatgaaatgcggacaattatggaaagtatttttgcttcatcaaataaagacacgagaaaattattgaaagatgcaacatcacaatttgaacaagcatggaaccaataa

SEQ ID NO: 2 - protein, 426 aa
MKFKTLATTVLATAAIFALGACGNGNGAKESNDIVKEVKEDTTITFWHAMNGVQEEALTKLTKDFMKENPKIKVELQNQSAYPDLQAKINSTLTSPKDLPTITQAYPGWLWNAAQDEMLVDLKPYMDDDTIGWKDAEPIREVLLDGAKIDGKQYGIPFNKSTEMLFYNADLLKEYGVEVPKTLEELKEASKTIYEKSNKEVVGAGFDSLNNYYAIGMKNKGVDFNKDLDLTSKDSQEVVDYYRDGIEAGYFRTAGSDKYLSGPFANKKVAMFVGSIAGAGFVQKDAEAGGYEYGVAPRPEKINLQQGTDIYMFDSATPEQRTAAFEFMKFLATPDSQLYWAQQTGYMPILESVLHSDEYKNSKTTKVPAQLENAVKDLFAIPVEENADSAYNEMRTIMESIFASSNKDTRKLLKDATSQFEQAWNQ

SEQ ID NO: 3 - DNA, 1216 bp; double-stranded, linear
ttgtggtaacggtaatggggccaaagaatcaaacgatattgtgaaagaagtgaaggaagatacgacaatcactttctggcatgcaatgaatggggttcaagaagaagcgttaacaaaattaacgaaagacttcatgaaagaaaatccaaaaattaaagtggaattacaaaatcaatctgcttaccctgatttacaagccaaaatcaattcgactttaacttcaccaaaagatttaccaacaattacgcaagcgtacccaggctggttatggaatgctgcacaagatgaaatgttagtggacttaaaaccatatatggatgatgacacaatcggctggaaagatgcagagccaattcgtgaagtattgttagacggcgccaaaatcgacggcaaacaatacggcattccatttaataaatcgacagaaatgttattctataatgctgatttgttgaaagaatatggtgttgaagtaccgaaaacattagaggaattaaaagaagcttctaaaacaatttacgaaaaatccaacaaagaagtcgttggtgctggttttgactcgttaaataactattacgcaattggaatgaaaaacaaaggcgttgattttaataaagacttagatttaacaagcaaagattcacaagaagtcgtggactattaccgtgatggtatcgaagcaggttacttccgcacagctggttcagataaatatttatctggcccatttgcaaacaaaaaggtagcaatgtttgtcggtagtattgctggtgctggttttgttcaaaaagatgctgaagctggtggctatgaatacggtgttgcaccacgtcctgaaaaaatcaacttacaacaaggaacagatatttatatgttcgatagtgctacgccagaacaacggacagcggcatttgaattcatgaaattcttagctactcctgattcacaattgtactgggcacaacaaacaggttatatgccaattttagaatctgttttacacagtgatgagtacaaaaattctaagacaaccaaagtacctgcacaacttgaaaacgcagtaaaagatttattcgctatcccagtagaagaaaatgctgattcagcctataatgaaatgcggacaattatggaaagtatttttgcttcatcaaataaagacacgagaaaattattgaaagatgcaacatcacaatttgaacaagcatggaaccaa

SEQ ID NO: 4 - protein, 405 aa
CGNGNGAKESNDIVKEVKEDTTITFWHAMNGVQEEALTKLTKDFMKENPKIKVELQNQSAYPDLQAKINSTLTSPKDLPTITQAYPGWLWNAAQDEMLVDLKPYMDDDTIGWKDAEPIREVLLDGAKIDGKQYGIPFNKSTEMLFYNADLLKEYGVEVPKTLEELKEASKTIYEKSNKEVVGAGFDSLNNYYAIGMKNKGVDFNKDLDLTSKDSQEVVDYYRDGIEAGYFRTAGSDKYLSGPFANKKVAMFVGSIAGAGFVQKDAEAGGYEYGVAPRPEKINLQQGTDIYMFDSATPEQRTAAFEFMKFLATPDSQLYWAQQTGYMPILESVLHSDEYKNSKTTKVPAQLENAVKDLFAIPVEENADSAYNEMRTIMESIFASSNKDTRKLLKDATSQFEQAWNQ

SEQ ID NO: 5 - DNA, 1161 bp; double-stranded, linear
taaatagcggaggtagtacaaatgaaattttggaaaaaaggcttaacagcggcagcgctgttagcagtggcggcagtaactttaacagcatgtggtggttcaagtgaaaagaaagcaactgaaaagagtgaagatggcaaaacaaaattaacagtaactacttggaattatgacacgaccccagaatttgagaaattattcagagcttttgaagcggaaaatcctgatatcactattgaaccggtggacattgcttcagatgattatgacacaaaagtaacaacgatgctttcatcaggagatacgacggatattttaaccatgaaaaacttactttcatattctaattacgcgctacgcaatcaattggtggatttaaccgatcacgttaaagatttagatatcgaacctgccaaagcaagttacgagatgtatgaaatcgatggtaaaacctatgctcagccttaccgtacagatttctgggtattgtattacaataaaaaaatgtttgatgaagccggaattgcctatcccgataacttaacttgggatgaatatgaagcgttagcgaaaaaattatctaaaccagaagaacaagtatatggtgcctatcaacatacttggcgctcaaccgttcaagcgattgctgctgctcaaaacaatgccaatttgattgaaccaaaatacaattatatggaaacttattatgatcgcgcattgagaatgcaaaaagatcaatcacaaatggattttggaacagcaaaatcaacaaaagtaacgtatcaatcacaatttgaaaattcaaaagcggcgatgatgtacatgggtagctggtacatggggactttattaacaaacattgatgatggcaaaacaaatgtcgaatgggggattgccgaaataccacaacaagaaaaaggcaaagcaactacctttggctcaccgacaagttttgcaattaataaaaacagtaaaaaacaaaaagctgctcaaaaattcttagactttgcttcaggtaaagaaggtgcaaaacttttagcagaagtaggggtggttccttcttataaaacagatgaaattgataaaatctactttgcaagaaaaggaatgccttcagacgagtctcacaaaaagcctttaacccagatacaattaatttag

SEQ ID NO: 6 - protein, 379 aa
MKFWKKGLTAAALLAVAAVTLTACGGSSEKKATEKSEDGKTKLTVTTWNYDTTPEFEKLFRAFEAENPDITIEPVDIASDDYDTKVTTMLSSGDTTDILTMKNLLSYSNYALRNQLVDLTDHVKDLDIEPAKASYEMYEIDGKTYAQPYRTDFWVLYYNKKMFDEAGIAYPDNLTWDEYEALAKKLSKPEEQVYGAYQHTWRSTVQAIAAAQNNANLIEPKYNYMETYYDRALRMQKDQSQMDFGTAKSTKVTYQSQFENSKAAMMYMGSWYMGTLLTNIDDGKTNVEWGIAEIPQQEKGKATTFGSPTSFAINKNSKKQKAAQKFLDFASGKEGAKLLAEVGVVPSYKTDEIDKIYFARKGMPSDESHKKPLTQIQLI

SEQ ID NO: 7 - DNA, 1069 bp; double-stranded, linear
atgtggtggttcaagtgaaaagaaagcaactgaaaagagtgaagatggcaaaacaaaattaacagtaactacttggaattatgacacgaccccagaatttgagaaattattcagagcttttgaagcggaaaatcctgatatcactattgaaccggtggacattgcttcagatgattatgacacaaaagtaacaacgatgctttcatcaggagatacgacggatattttaaccatgaaaaacttactttcatattctaattacgcgctacgcaatcaattggtggatttaaccgatcacgttaaagatttagatatcgaacctgccaaagcaagttacgagatgtatgaaatcgatggtaaaacctatgctcagccttaccgtacagatttctgggtattgtattacaataaaaaaatgtttgatgaagccggaattgcctatcccgataacttaacttgggatgaatatgaagcgttagcgaaaaaattatctaaaccagaagaacaagtatatggtgcctatcaacatacttggcgctcaaccgttcaagcgattgctgctgctcaaaacaatgccaatttgattgaaccaaaatacaattatatggaaacttattatgatcgcgcattgagaatgcaaaaagatcaatcacaaatggattttggaacagcaaaatcaacaaaagtaacgtatcaatcacaatttgaaaattcaaaagcggcgatgatgtacatgggtagctggtacatggggactttattaacaaacattgatgatggcaaaacaaatgtcgaatgggggattgccgaaataccacaacaagaaaaaggcaaagcaactacctttggctcaccgacaagttttgcaattaataaaaacagtaaaaaacaaaaagctgctcaaaaattcttagactttgcttcaggtaaagaaggtgcaaaacttttagcagaagtaggggtggttccttcttataaaacagatgaaattgataaaatctactttgcaagaaaaggaatgccttcagacgagtctcacaaaaagcctttaacccagatacaattaatt

SEQ ID NO: 8 - protein, 356 aa
CGGSSEKKATEKSEDGKTKLTVTTWNYDTTPEFEKLFRAFEAENPDITIEPVDIASDDYDTKVTTMLSSGDTTDILTMKNLLSYSNYALRNQLVDLTDHVKDLDIEPAKASYEMYEIDGKTYAQPYRTDFWVLYYNKKMFDEAGIAYPDNLTWDEYEALAKKLSKPEEQVYGAYQHTWRSTVQAIAAAQNNANLIEPKYNYMETYYDRALRMQKDQSQMDFGTAKSTKVTYQSQFENSKAAMMYMGSWYMGTLLTNIDDGKTNVEWGIAEIPQQEKGKATTFGSPTSFAINKNSKKQKAAQKFLDFASGKEGAKLLAEVGVVPSYKTDEIDKIYFARKGMPSDESHKKPLTQIQLI

SEQ ID NO: 9 - DNA, 834 bp; double-stranded, linear
taggaggacaaaagaatgaagaagttttatttagcnacattcgctgttattgcaacagttattttagctgcctgtgggggaaataaacaagcagaccagaaagaagacaaggagattaccgttgccgtgcaattggaatcttcaaaagatatcttggagattgccaagaaagaagctgagaaaaaagggtacaaaattaacattatggaagtgagcgacaatgttgcctacaacgatgccgtgcaacatgacgaagcggatgctaattttgcgcaacatcaacccttcatggaaatgtttaacaaagagaaaaaagctgatttagtggctgtgcaaccgatttattattttgctggtggtttctattcaaaagaataccaagatgcgaaagatttacctgaaaatgccaaagtggggattcctagcgatccaaccaatgaaggtcgtgctttagcaattttaaatgcaaacggcgtgattaaattaaaagaaggtgtcggctttaacggcacggtggcagatgtcgtggaaaatcctaaaaacatcacttttgaaagcattgatttactgaatttagctaaagcctatgatgaaaaagacatcgctatggtgttctgctacccagcctacttagaacctgctggtttaacaacgaaagatgcgatcttgttagaagataaagaagcaagtaaacattacgcattgcaagttgtgacacgcaaaggcgaaaaagatagcgaaaaaatcaaggttttaaaagaagcgatgacaacaaaagaagttgctgaatacatcaagaaaaattctaaaggcgccaatattcctgcgttttaa

SEQ ID NO: 10 - protein, 272 aa
MKKFYLATFAVIATVILAACGGNKQADQKEDKEITVAVQLESSKDILEIAKKEAEKKGYKINIMEVSDNVAYNDAVQHDEADANFAQHQPFMEMFNKEKKADLVAVQPIYYFAGGFYSKEYQDAKDLPENAKVGIPSDPTNEGRALAILNANGVIKLKEGVGFNGTVADVVENPKNITFESIDLLNLAKAYDEKDIAMVFCYPAYLEPAGLTTKDAILLEDKEASKHYALQVVTRKGEKDSEKIKVLKEAMTTKEVAEYIKKNSKGANIPAF

SEQ ID NO: 11 - DNA, 760 bp; double-stranded, linear
ctgtgggggaaataaacaagcagaccagaaagaagacaaggagattaccgttgccgtgcaattggaatcttcaaaagatatcttggagattgccaagaaagaagctgagaaaaaagggtacaaaattaacattatggaagtgagcgacaatgttgcctacaacgatgccgtgcaacatgacgaagcggatgctaattttgcgcaacatcaacccttcatggaaatgtttaacaaagagaaaaaagctgatttagtggctgtgcaaccgatttattattttgctggtggtttctattcaaaagaataccaagatgcgaaagatttacctgaaaatgccaaagtggggattcctagcgatccaaccaatgaaggtcgtgctttagcaattttaaatgcaaacggcgtgattaaattaaaagaaggtgtcggctttaacggcacggtggcagatgtcgtggaaaatcctaaaaacatcacttttgaaagcattgatttactgaatttagctaaagcctatgatgaaaaagacatcgctatggtgttctgctacccagcctacttagaacctgctggtttaacaacgaaagatgcgatcttgttagaagataaagaagcaagtaaacattacgcattgcaagttgtgacacgcaaaggcgaaaaagatagcgaaaaaatcaaggttttaaaagaagcgatgacaacaaaagaagttgctgaatacatcaagaaaaattctaaaggcgccaatattcctgcgttt

SEQ ID NO: 12 - protein, 253 aa
CGGNKQADQKEDKEITVAVQLESSKDILEIAKKEAEKKGYKINIMEVSDNVAYNDAVQHDEADANFAQHQPFMEMFNKEKKADLVAVQPIYYFAGGFYSKEYQDAKDLPENAKVGIPSDPTNEGRALAILNANGVIKLKEGVGFNGTVADVVENPKNITFESIDLLNLAKAYDEKDIAMVFCYPAYLEPAGLTTKDAILLEDKEASKHYALQVVTRKGEKDSEKIKVLKEAMTTKEVAEYIKKNSKGANIPAF

SEQ ID NO: 13 - DNA, 555 bp; double-stranded, linear
taaatcgaaagaaggatgatagaaatgaaaaaaatgattaaatttgcaggcattgctcttatttttgcagctcttctctctgcctgtagcaacgcaaaaaataatacacaaaagaaagccgaaactgctgcccagtcaagcactattgaagcttcagacagtaacgaaaacgagcctaatacagaaaacataacccaagcagttaaacagttagaagaaaaatttaactctgacgagaaattagtaaaaatagatgttaaaaataatgttaaagatgacacatcagataaccctcacgctgtcattacggttaaggtaattaatgatgaagcaaaaaaaaatatggaagaaatgcagactgcgatagattccaactcaggtacagaggcacaaaagactgccatatacggaattcaattaaatgttgaagaagtagccaaaacattagaaaatgataacgatgttatttctttcatcacaccttacacgaatgggaacgacagaaccatagcaaaatcaactaaaaatgaaaatattattccgttagtaaaataa

SEQ ID NO: 14 - protein, 176 aa
MKKMIKFAGIALIFAALLSACSNAKNNTQKKAETAAQSSTIEASDSNENEPNTENITQAVKQLEEKFNSDEKLVKIDVKNNVKDDTSDNPHAVITVKVINDEAKKNMEEMQTAIDSNSGTEAQKTAIYGIQLNVEEVAKTLENDNDVISFITPYTNGNDRTIAKSTKNENIIPLVK

SEQ ID NO: 15 - DNA, 469 bp; double-stranded, linear
ctgtagcaacgcaaaaaataatacacaaaagaaagccgaaactgctgcccagtcaagcactattgaagcttcagacagtaacgaaaacgagcctaatacagaaaacataacccaagcagttaaacagttagaagaaaaatttaactctgacgagaaattagtaaaaatagatgttaaaaataatgttaaagatgacacatcagataaccctcacgctgtcattacggttaaggtaattaatgatgaagcaaaaaaaaatatggaagaaatgcagactgcgatagattccaactcaggtacagaggcacaaaagactgccatatacggaattcaattaaatgttgaagaagtagccaaaacattagaaaatgataacgatgttatttctttcatcacaccttacacgaatgggaacgacagaaccatagcaaaatcaactaaaaatgaaaatattattccgttagtaaaa

SEQ ID NO: 16 - protein, 156 aa
CSNAKNNTQKKAETAAQSSTIEASDSNENEPNTENITQAVKQLEEKFNSDEKLVKIDVKNNVKDDTSDNPHAVITVKVINDEAKKNMEEMQTAIDSNSGTEAQKTAIYGIQLNVEEVAKTLENDNDVISFITPYTNGNDRTIAKSTKNENIIPLVK

SEQ ID NO: 17 - DNA, 825 bp; double-stranded, linear
taaaaaatgaaaaaacgattgacgattgtggggatgctttttctggccattttagtaatggttggttgtggtaaaaatcagcaagcaacgacaaaagaaaaagagacaaaacctgaagaactaactctttacattgtgcgccacggaaaaaccatgttaaatacgacggaccgcgtacaaggatggtcagatgcggtcctaacaccagaaggtgaaaaagttgtgacagcaactgggattggactgaaagatgttgcctttcaaaatgcatatagtagtgatagtggccgcgccttgcaaactgctcaacttattttagatcaaaataaagcaggcaaagaccttgaagtcgtgcgtgacccagatttacgtgaatttaattttggtagctatgaaggggatttaaataagacaatgtggcaggatattgctgatgatcaaggtgtttccttagaagaatttatgaaaaacatgactcctgaatcctttgccaatagtgtagctaaactggatcaacagcgcgaggaaagcaagaataactggcctgcagaagactatgctacaattactaaacgtttgaaaaaaggcttagataaaattgttgccacagaatcagccaattctgggaatggcaatgttttagtggtctctcatggcttgagtatttcagcgttgttagcaactttatttgatgattttaaagtcccagaaggcggtttgaagaatgctagtgtcacaacaattcattacaaaaatggcgaatatactttggataaagtcaatgatgtcagctacttagaagcaggcgaaaaagaatcaaaataa

SEQ ID NO: 18 - protein, 272 aa
MKKRLTIVGMLFLAILVMVGCGKNQQATTKEKETKPEELTLYIVRHGKTMLNTTDRVQGWSDAVLTPEGEKVVTATGIGLKDVAFQNAYSSDSGRALQTAQLILDQNKAGKDLEVVRDPDLREFNFGSYEGDLNKTMWQDIADDQGVSLEEFMKNMTPESFANSVAKLDQQREESKNNWPAEDYATITKRLKKGLDKIVATESANSGNGNVLVVSHGLSISALLATLFDDFKVPEGGLKNASVTTIHYKNGEYTLDKVNDVSYLEAGEKESK

SEQ ID NO: 19 - DNA, 757 bp; double-stranded, linear
ttgtggtaaaaatcagcaagcaacgacaaaagaaaaagagacaaaacctgaagaactaactctttacattgtgcgccacggaaaaaccatgttaaatacgacggaccgcgtacaaggatggtcagatgcggtcctaacaccagaaggtgaaaaagttgtgacagcaactgggattggactgaaagatgttgcctttcaaaatgcatatagtagtgatagtggccgcgccttgcaaactgctcaacttattttagatcaaaataaagcaggcaaagaccttgaagtcgtgcgtgacccagatttacgtgaatttaattttggtagctatgaaggggatttaaataagacaatgtggcaggatattgctgatgatcaaggtgtttccttagaagaatttatgaaaaacatgactcctgaatcctttgccaatagtgtagctaaactggatcaacagcgcgaggaaagcaagaataactggcctgcagaagactatgctacaattactaaacgtttgaaaaaaggcttagataaaattgttgccacagaatcagccaattctgggaatggcaatgttttagtggtctctcatggcttgagtatttcagcgttgttagcaactttatttgatgattttaaagtcccagaaggcggtttgaagaatgctagtgtcacaacaattcattacaaaaatggcgaatatactttggataaagtcaatgatgtcagctacttagaagcaggcgaaaaagaatcaaaa

SEQ ID NO: 20 - protein, 252 aa
CGKNQQATTKEKETKPEELTLYIVRHGKTMLNTTDRVQGWSDAVLTPEGEKVVTATGIGLKDVAFQNAYSSDSGRALQTAQLILDQNKAGKDLEVVRDPDLREFNFGSYEGDLNKTMWQDIADDQGVSLEEFMKNMTPESFANSVAKLDQQREESKNNWPAEDYATITKRLKKGLDKIVATESANSGNGNVLVVSHGLSISALLATLFDDFKVPEGGLKNASVTTIHYKNGEYTLDKVNDVSYLEAGEKESK

SEQ ID NO: 21 - DNA, 843 bp; double-stranded, linear
taaacgataaatggagggaataagatgaaaaaacgtacattatggtcagtaattactgtagcagtagctgtcttagttttaggggcttgcggcaataaaaagagtgatgactcggtcttgaaagttggagcttcaccagttccacatgcagagattttagaacatgtaaaacctttattagaaaaagaaggcgtaaaattagaagtgacgacttatacagattacgtgctacctaacaaggcgttggaaagtggcgatatcgatgccaactatttccaacatgtgccgttctttaatgaagcggttaaagaaaatgattatgactttgtgaatgcaggtgcgattcatttagaaccagttgggctttactcgaaaaaatacaaatcgttacaagaaattcctgatggttcaacgatttacgttagctcttccgtttcagattggccacgcgtattaactatcttagaagatgctggtttaatcacgctgaaagaaggggtagaccggacaactgctactttcgatgatattgataaaaatactaaaaagttgaaattcaatcatgaaagtgatccagcaatcatgaccactctttatgacaatgaagaaggggctgcggttttaattaactcaaactttgccgtggatcaaggattaaatccgaaaaaagatgcgattgccttagaaaaagaaagttcaccttatgccaatattattgcggttcgtaaagaagacgaaaacaacgaaaatgtaaaaaaattagtcaaagtgttacgtagcaaagaagtccaagattggattacgaaaaaatggaacggcgctattgttccagtcaatgaataa

SEQ ID NO: 22 - protein, 272 aa
MKKRTLWSVITVAVAVLVLGACGNKKSDDSVLKVGASPVPHAEILEHVKPLLEKEGVKLEVTTYTDYVLPNKALESGDIDANYFQHVPFFNEAVKENDYDFVNAGAIHLEPVGLYSKKYKSLQEIPDGSTIYVSSSVSDWPRVLTILEDAGLITLKEGVDRTTATFDDIDKNTKKLKFNHESDPAIMTTLYDNEEGAAVLINSNFAVDQGLNPKKDAIALEKESSPYANIIAVRKEDENNENVKKLVKVLRSKEVQDWITKKWNGAIVPVNE

SEQ ID NO: 23 - DNA, 754 bp; double-stranded, linear
ttgcggcaataaaaagagtgatgactcggtcttgaaagttggagcttcaccagttccacatgcagagattttagaacatgtaaaacctttattagaaaaagaaggcgtaaaattagaagtgacgacttatacagattacgtgctacctaacaaggcgttggaaagtggcgatatcgatgccaactatttccaacatgtgccgttctttaatgaagcggttaaagaaaatgattatgactttgtgaatgcaggtgcgattcatttagaaccagttgggctttactcgaaaaaatacaaatcgttacaagaaattcctgatggttcaacgatttacgttagctcttccgtttcagattggccacgcgtattaactatcttagaagatgctggtttaatcacgctgaaagaaggggtagaccggacaactgctactttcgatgatattgataaaaatactaaaaagttgaaattcaatcatgaaagtgatccagcaatcatgaccactctttatgacaatgaagaaggggctgcggttttaattaactcaaactttgccgtggatcaaggattaaatccgaaaaaagatgcgattgccttagaaaaagaaagttcaccttatgccaatattattgcggttcgtaaagaagacgaaaacaacgaaaatgtaaaaaaattagtcaaagtgttacgtagcaaagaagtccaagattggattacgaaaaaatggaacggcgctattgttccagtcaatgaa

SEQ ID NO: 24 - protein, 251 aa
CGNKKSDDSVLKVGASPVPHAEILEHVKPLLEKEGVKLEVTTYTDYVLPNKALESGDIDANYFQHVPFFNEAVKENDYDFVNAGAIHLEPVGLYSKKYKSLQEIPDGSTIYVSSSVSDWPRVLTILEDAGLITLKEGVDRTTATFDDIDKNTKKLKFNHESDPAIMTTLYDNEEGAAVLINSNFAVDQGLNPKKDAIALEKESSPYANIIAVRKEDENNENVKKLVKVLRSKEVQDWITKKWNGAIVPVNE

SEQ ID NO: 25 - DNA, 960 bp; double-stranded, linear
taaaccgtgagaaagaaatggaggaatcaacgaatgaaaaaatttagtttattttttttaacacttttagcagggttaacgttagctgcttgcgggaatcaagccgctgaaaagaaagaaaaattagcaattgtgacaacgaactcgatcctatctgatttagtgaaaaatgttgggcaagacaaaattgagctgcatagtattgtgccaattgggacagaccctcacgaatatgaaccgttaccagaagacattgcgaaagcttctgaagcggacattttattctttaacggcttgaacttagaaacaggcggaaatggctggtttaacaaattaatgaaaacggccaaaaaagttgagaataaagattacttttctacaagcaaaaatgttacgccacaatatttaacaagtgccggtcaagaacaaacagaagatccacatgcttggttagacattgaaaatggcattaaatatgtagaaaacattcgtgacgtgttagtagaaaaagatccaaaaaataaagatttctatacagaaaacgcgaaaaattataccgaaaaacttagcaaactacatgaggaagccaaagctaaatttgctgatattcctgatgataaaaaattattagttacaagtgaaggtgcctttaaatatttctccaaagcttatgatttaaatgccgcttatatttgggaaattaacacagaaagtcaaggnacacctgaacaaatgaccacgattattgataccattaagaaatcaaaagcacctgtgttatttgttgaaaccagtgtcgataaacgtagtatggaacgggtctcaaaagaagtgaaacgaccaatttacgatacacttttcacagactctcttgccaaagaaggaacagaaggcgatacgtactacagcatgatgaactggaatttaacaaaaatccatgatggcttaatgagtaaataa

SEQ ID NO: 26 - protein, 308 aa
MKKFSLFFLTLLAGLTLAACGNQAAEKKEKLAIVTTNSILSDLVKNVGQDKIELHSIVPIGTDPHEYEPLPEDIAKASEADILFFNGLNLETGGNGWFNKLMKTAKKVENKDYFSTSKNVTPQYLTSAGQEQTEDPHAWLDIENGIKYVENIRDVLVEKDPKNKDFYTENAKNYTEKLSKLHEEAKAKFADIPDDKKLLVTSEGAFKYFSKAYDLNAAYIWEINTESQGTPEQMTTIIDTIKKSKAPVLFVETSVDKRSMERVSKEVKRPIYDTLFTDSLAKEGTEGDTYYSMMNWNLTKIHDGLMSK

SEQ ID NO: 27 - DNA, 868 bp; double-stranded, linear
ttgcgggaatcaagccgctgaaaagaaagaaaaattagcaattgtgacaacgaactcgatcctatctgatttagtgaaaaatgttgggcaagacaaaattgagctgcatagtattgtgccaattgggacagaccctcacgaatatgaaccgttaccagaagacattgcgaaagcttctgaagcggacattttattctttaacggcttgaacttagaaacaggcggaaatggctggtttaacaaattaatgaaaacggccaaaaaagttgagaataaagattacttttctacaagcaaaaatgttacgccacaatatttaacaagtgccggtcaagaacaaacagaagatccacatgcttggttagacattgaaaatggcattaaatatgtagaaaacattcgtgacgtgttagtagaaaaagatccaaaaaataaagatttctatacagaaaacgcgaaaaattataccgaaaaacttagcaaactacatgaggaagccaaagctaaatttgctgatattcctgatgataaaaaattattagttacaagtgaaggtgcctttaaatatttctccaaagcttatgatttaaatgccgcttatatttgggaaattaacacagaaagtcaaggnacacctgaacaaatgaccacgattattgataccattaagaaatcaaaagcacctgtgttatttgttgaaaccagtgtcgataaacgtagtatggaacgggtctcaaaagaagtgaaacgaccaatttacgatacacttttcacagactctcttgccaaagaaggaacagaaggcgatacgtactacagcatgatgaactggaatttaacaaaaatccatgatggcttaatgagtaaa

SEQ ID NO: 28 - protein, 289 aa
CGNQAAEKKEKLAIVTTNSILSDLVKNVGQDKIELHSIVPIGTDPHEYEPLPEDIAKASEADILFFNGLNLETGGNGWFNKLMKTAKKVENKDYFSTSKNVTPQYLTSAGQEQTEDPHAWLDIENGIKYVENIRDVLVEKDPKNKDFYTENAKNYTEKLSKLHEEAKAKFADIPDDKKLLVTSEGAFKYFSKAYDLNAAYIWEINTESQGTPEQMTTIIDTIKKSKAPVLFVETSVDKRSMERVSKEVKRPIYDTLFTDSLAKEGTEGDTYYSMMNWNLTKIHDGLMSK

SEQ ID NO: 29 - DNA, 840 bp; double-stranded, linear
tgacaaatgaaaaaatttagtaaattaattggacttattggggtattagcttttacgattgcaggttgtgcatcggggtctgtgaaggatactaagacagaaaccgttaaactaggggttgtaggaacaaaaaatgatgaatgggaatcggtcaaagaccgtttgaaaaagaaaaatattgatttacaattggtagaatttacagactatacgcaaccaaacgcagcattagcagaaaaagaaattgatttaaatgcctttcagcatcaaatctttttagacaattacaataaagagcatggaacgaaattagtatcaattggcaatacagtcaatgcaccattgggaatttacgctaataaattgaaagatatcacgaaaattaaagacggcggagaaattgctattcctaatgacccaacgaatggcgggcgggcgttaattttattacaaactgcaggactgataaaagtagatcctgcgaaacagcaactaccgactgtcagtgatattactgaaaataaacgccaattgaaaataactgaattagatgctacgcaaacagcgcgcgctttacaagatgtcgatgcttcagtgattaatagcggcatggctgtcgatgctgggtatacaccagataaagatgctattttcttagaacctgtaaacgaaaaagcgaaaccttatgtgaacattgtcgtggcccgagaagaagatcaagagaataaactttatcaaaaagttgtagaagaatatcaacaagaagaaacgaaaaaggtcattgcagaaacatcaaaaggcgccaatgttccagcctgggaaacatttggtaaaaaataa

SEQ ID NO: 30 - protein, 277 aa
MKKFSKLIGLIGVLAFTIAGCASGSVKDTKTETVKLGVVGTKNDEWESVKDRLKKKNIDLQLVEFTDYTQPNAALAEKEIDLNAFQHQIFLDNYNKEHGTKLVSIGNTVNAPLGIYANKLKDITKIKDGGEIAIPNDPTNGGRALILLQTAGLIKVDPAKQQLPTVSDITENKRQLKITELDATQTARALQDVDASVINSGMAVDAGYTPDKDAIFLEPVNEKAKPYVNIVVAREEDQENKLYQKVVEEYQQEETKKVIAETSKGANVPAWETFGKK

SEQ ID NO: 31 - DNA, 772 bp; double-stranded, linear
ttgtgcatcggggtctgtgaaggatactaagacagaaaccgttaaactaggggttgtaggaacaaaaaatgatgaatgggaatcggtcaaagaccgtttgaaaaagaaaaatattgatttacaattggtagaatttacagactatacgcaaccaaacgcagcattagcagaaaaagaaattgatttaaatgcctttcagcatcaaatctttttagacaattacaataaagagcatggaacgaaattagtatcaattggcaatacagtcaatgcaccattgggaatttacgctaataaattgaaagatatcacgaaaattaaagacggcggagaaattgctattcctaatgacccaacgaatggcgggcgggcgttaattttattacaaactgcaggactgataaaagtagatcctgcgaaacagcaactaccgactgtcagtgatattactgaaaataaacgccaattgaaaataactgaattagatgctacgcaaacagcgcgcgctttacaagatgtcgatgcttcagtgattaatagcggcatggctgtcgatgctgggtatacaccagataaagatgctattttcttagaacctgtaaacgaaaaagcgaaaccttatgtgaacattgtcgtggcccgagaagaagatcaagagaataaactttatcaaaaagttgtagaagaatatcaacaagaagaaacgaaaaaggtcattgcagaaacatcaaaaggcgccaatgttccagcctgggaaacatttggtaaaaaa

SEQ ID NO: 32 - protein, 257 aa
CASGSVKDTKTETVKLGVVGTKNDEWESVKDRLKKKNIDLQLVEFTDYTQPNAALAEKEIDLNAFQHQIFLDNYNKEHGTKLVSIGNTVNAPLGIYANKLKDITKIKDGGEIAIPNDPTNGGRALILLQTAGLIKVDPAKQQLPTVSDITENKRQLKITELDATQTARALQDVDASVINSGMAVDAGYTPDKDAIFLEPVNEKAKPYVNIVVAREEDQENKLYQKVVEEYQQEETKKVIAETSKGANVPAWETFGKK

SEQ ID NO: 33 - DNA, 1500 bp; double-stranded, linear
tgaaagaataaaattgtacaggaggaaataaggaatgaaaaaatggcaaaaaggattagccgtagctggcgcacagctttagctgtaggactaagcgcgtgcggtaaatcttcaaaagatgcagcgtcaaaaggtgatgatagtacaccaacgttattaatgtatcgtgttggggacaaaccagataattatgaccaattaatcgataatgcgaataaaattatcgagaaaaaaattggggcaaaattaaaaatggaatttgttggttggggcgattgggaccaaaaaatgtcaacaatcgttgcttctggtgaaagctatgatatttcattagcacaaaattatgcaacgaatgcacaaaaaggcgcctatgctgatttaactgatttagcacctaaatatgccaaagaagcctatgatcaattgccagataactatattaaaggaaatacgattaatggaaaactgtatgcgttcccaattttaggtaactcttacggtcaacaagttttaacttttaataaagaatatgtcgataaatacaatttagatattagtaaagtcgatggtagttatgaaagtgcaacggaagttctaaaagaattccntaaaaanganccaaatattgctgcttttgctatcggccaaacattctttgcaacaggtaattatgacttccctattggtaaccaatatccatttgcagtaaaaacaactgatactggctcaccaaaaattattaaccaatatgccgacaaagacatgattaataacttaaaagtcttgcatcaatggtataaagatggcttgattccaacagatgctgctacaagtacaacaccatatgacttaaataccaatacttggtttatgcgtcaagaaacacaaggacctatggattatggtgatacaatcttaacacaagctgctggcaaaccacttgtttctcgtccactaacagaaccattaaaaacaacagctcaagcgcaaatggctaactatgttgttgcaaacacgtctaaaaacaaagaaaaatctgttgaattgttaggtttattaaacagcaatccagaattgttaaacggacttgtttatggtgaagaaggcaaacaatatgaaaaagttggcgatgatcgtgtgaaattgttgaaagattacacaccaacaactcatttgagtgcttggaacacaggaaacaacttaatcatttggccagaagaatctgtcactgaagaaatggttaaagaacgtgataagagcatcgaagaagcaaaagattcaccaattcttggttttacttttgtaaatgataaagtgaaaactgaaatcactaacgttgctacagttatgaaccgttacgcagcaagcttaaatacaggaactgttgatccagaagaaacacttccaaaattaatggatgacctaaaaacagctggctgggataaagttcaaaaagaaatgcaaacacaattagacgaatatatccaatctcaaaaataa

SEQ ID NO: 34 - protein, 485 aa
MAKRISRSWRTALAVGLSACGKSSKDAASKGDDSTPTLLMYRVGDKPDNYDQLIDNANKIIEKKIGAKLKMEFVGWGDWDQKMSTIVASGESYDISLAQNYATNAQKGAYADLTDLAPKYAKEAYDQLPDNYIKGNTINGKLYAFPILGNSYGQQVLTFNKEYVDKYNLDISKVDGSYESATEVLKEFXKXXPNIAAFAIGQTFFATGNYDFPIGNQYPFAVKTTDTGSPKIINQYADKDMINNLKVLHQWYKDGLIPTDAATSTTPYDLNTNTWFMRQETQGPMDYGDTILTQAAGKPLVSRPLTEPLKTTAQAQMANYVVANTSKNKEKSVELLGLLNSNPELLNGLVYGEEGKQYEKVGDDRVKLLKDYTPTTHLSAWNTGNNLIIWPEESVTEEMVKERDKSIEEAKDSPILGFTFVNDKVKTEITNVATVMNRYAASLNTGTVDPEETLPKLMDDLKTAGWDKVQKEMQTQLDEYIQSQK

SEQ ID NO: 35 - DNA, 1399 bp; double-stranded, linear
gtgcggtaaatcttcaaaagatgcagcgtcaaaaggtgatgatagtacaccaacgttattaatgtatcgtgttggggacaaaccagataattatgaccaattaatcgataatgcgaataaaattatcgagaaaaaaattggggcaaaattaaaaatggaatttgttggttggggcgattgggaccaaaaaatgtcaacaatcgttgcttctggtgaaagctatgatatttcattagcacaaaattatgcaacgaatgcacaaaaaggcgcctatgctgatttaactgatttagcacctaaatatgccaaagaagcctatgatcaattgccagataactatattaaaggaaatacgattaatggaaaactgtatgcgttcccaattttaggtaactcttacggtcaacaagttttaacttttaataaagaatatgtcgataaatacaatttagatattagtaaagtcgatggtagttatgaaagtgcaacggaagttctaaaagaattccntaaaaanganccaaatattgctgcttttgctatcggccaaacattctttgcaacaggtaattatgacttccctattggtaaccaatatccatttgcagtaaaaacaactgatactggctcaccaaaaattattaaccaatatgccgacaaagacatgattaataacttaaaagtcttgcatcaatggtataaagatggcttgattccaacagatgctgctacaagtacaacaccatatgacttaaataccaatacttggtttatgcgtcaagaaacacaaggacctatggattatggtgatacaatcttaacacaagctgctggcaaaccacttgtttctcgtccactaacagaaccattaaaaacaacagctcaagcgcaaatggctaactatgttgttgcaaacacgtctaaaaacaaagaaaaatctgttgaattgttaggtttattaaacagcaatccagaattgttaaacggacttgtttatggtgaagaaggcaaacaatatgaaaaagttggcgatgatcgtgtgaaattgttgaaagattacacaccaacaactcatttgagtgcttggaacacaggaaacaacttaatcatttggccagaagaatctgtcactgaagaaatggttaaagaacgtgataagagcatcgaagaagcaaaagattcaccaattcttggttttacttttgtaaatgataaagtgaaaactgaaatcactaacgttgctacagttatgaaccgttacgcagcaagcttaaatacaggaactgttgatccagaagaaacacttccaaaattaatggatgacctaaaaacagctggctgggataaagttcaaaaagaaatgcaaacacaattagacgaatatatccaatctcaaaaa

SEQ ID NO: 36 - protein, 466 aa
CGKSSKDAASKGDDSTPTLLMYRVGDKPDNYDQLIDNANKIIEKKIGAKLKMEFVGWGDWDQKMSTIVASGESYDISLAQNYATNAQKGAYADLTDLAPKYAKEAYDQLPDNYIKGNTINGKLYAFPILGNSYGQQVLTFNKEYVDKYNLDISKVDGSYESATEVLKEFXKXXPNIAAFAIGQTFFATGNYDFPIGNQYPFAVKTTDTGSPKIINQYADKDMINNLKVLHQWYKDGLIPTDAATSTTPYDLNTNTWFMRQETQGPMDYGDTILTQAAGKPLVSRPLTEPLKTTAQAQMANYVVANTSKNKEKSVELLGLLNSNPELLNGLVYGEEGKQYEKVGDDRVKLLKDYTPTTHLSAWNTGNNLIIWPEESVTEEMVKERDKSIEEAKDSPILGFTFVNDKVKTEITNVATVMNRYAASLNTGTVDPEETLPKLMDDLKTAGWDKVQKEMQTQLDEYIQSQK

SEQ ID NO: 37 - DNA, 975 bp; double-stranded, linear
taacgtttttggaggaaaagaatgaaaaagaaatttttagcaatgatggcagtttcaatgatgggactgttaatgttaagtgcttgtcaaacaaataaaaaaacagcagattctgcaacaacagaaacaacagctaaaacggaagtcacagtcaaagacaccaatggtcaattaaccgttcccaaaaatcctaagaaagtcgttgtttttgataatggttccttggatacaatggatgcactaggtgtcggtgaccgcgtggtaggtgcgccaactaaaaatatccctgcgtatttgaaaaaataccaaaaagttgaatcagcaggcggcattaaagaaccagatttagaaaaaatcaatcaactaaaaccagacttaattattatttctggtcgtcaacaagattatcaagaacaattaaaagccattgcgccaaccatttacttagctgtagatgccaaaaatccttgggcatcaacgaaacaaaatatcgaaacgttaggcactatttttgataaagaagaggtagctaaagaaaaaataactggcttagaaaaagaaattgctgacgtgaaaaaacaagcagaagctagcgcgaataatgcgcttgttgtgttagttaacgaaggacaactttccgcttacggaaaaggctctcgtttcggtttaattcatgatacatttggcttcaaagcagcagacgataagattgaagcttccactcatgggcaaagtgtttcttacgaatatgttttagaaaaaaatcctgggattctctttgtggtagatcgcaccaaagcaattggtggcgacgattcaaaagataacgtcgctgcaaacgaattgattcaaaaaaccgatgctggtaaaaatgataaagtcattatgcttcaaccagatgtttggtatctaagcggtggtggattagaatcaatgcatttgatgatagaagatgttaaaaaaggattagagtaa

SEQ ID NO: 38 - protein, 317 aa
MKKKFLAMMAVSMMGLLMLSACQTNKKTADSATTETTAKTEVTVKDTNGQLTVPKNPKKVVVFDNGSLDTMDALGVGDRVVGAPTKNIPAYLKKYQKVESAGGIKEPDLEKINQLKPDLIIISGRQQDYQEQLKAIAPTIYLAVDAKNPWASTKQNIETLGTIFDKEEVAKEKITGLEKEIADVKKQAEASANNALVVLVNEGQLSAYGKGSRFGLIHDTFGFKAADDKIEASTHGQSVSYEYVLEKNPGILFVVDRTKAIGGDDSKDNVAANELIQKTDAGKNDKVIMLQPDVWYLSGGGLESMHLMIEDVKKGLE

SEQ ID NO: 39 - DNA, 889 bp; double-stranded, linear
ttgtcaaacaaataaaaaaacagcagattctgcaacaacagaaacaacagctaaaacggaagtcacagtcaaagacaccaatggtcaattaaccgttcccaaaaatcctaagaaagtcgttgtttttgataatggttccttggatacaatggatgcactaggtgtcggtgaccgcgtggtaggtgcgccaactaaaaatatccctgcgtatttgaaaaaataccaaaaagttgaatcagcaggcggcattaaagaaccagatttagaaaaaatcaatcaactaaaaccagacttaattattatttctggtcgtcaacaagattatcaagaacaattaaaagccattgcgccaaccatttacttagctgtagatgccaaaaatccttgggcatcaacgaaacaaaatatcgaaacgttaggcactatttttgataaagaagaggtagctaaagaaaaaataactggcttagaaaaagaaattgctgacgtgaaaaaacaagcagaagctagcgcgaataatgcgcttgttgtgttagttaacgaaggacaactttccgcttacggaaaaggctctcgtttcggtttaattcatgatacatttggcttcaaagcagcagacgataagattgaagcttccactcatgggcaaagtgtttcttacgaatatgttttagaaaaaaatcctgggattctctttgtggtagatcgcaccaaagcaattggtggcgacgattcaaaagataacgtcgctgcaaacgaattgattcaaaaaaccgatgctggtaaaaatgataaagtcattatgcttcaaccagatgtttggtatctaagcggtggtggattagaatcaatgcatttgatgatagaagatgttaaaaaaggattagag

SEQ ID NO: 40 - protein, 296 aa
CQTNKKTADSATTETTAKTEVTVKDTNGQLTVPKNPKKVVVFDNGSLDTMDALGVGDRVVGAPTKNIPAYLKKYQKVESAGGIKEPDLEKINQLKPDLIIISGRQQDYQEQLKAIAPTIYLAVDAKNPWASTKQNIETLGTIFDKEEVAKEKITGLEKEIADVKKQAEASANNALVVLVNEGQLSAYGKGSRFGLIHDTFGFKAADDKIEASTHGQSVSYEYVLEKNPGILFVVDRTKAIGGDDSKDNVAANELIQKTDAGKNDKVIMLQPDVWYLSGGGLESMHLMIEDVKKGLE

SEQ ID NO: 41 - DNA, 1659 bp; double-stranded, linear
tgagggggcaacaacatgaaattggggaaaaaagtagtaggtttgattgcaacagggtttcttttagccgcatgtggcggaaccaaagaagcggcagagaaagtagattcgggaaatttagcagctgaacaaaaaatcagtattagttcacctgcaccaatctcaacattggatacaacacaaacaacagataaaaatacctttacaatggcacaacatttatttgaaggcctttatcggtttgatgatgatagtgccacggtgccagctctagctaaagatgtcaagattagtgacgatgggcgcaagtaccactttaccttgcgggaggggattaagtggagcaacggcgagccaatcacggcccaagattttgtttattcttggaaaaaactggtgacaccagcgacgattggaccgaatgcctatttactagacagtgttaaaaatagttttgaaatacgcaacggtgaaaagtcagtcgatgaattagggatttcagccccgaatgacaaagaattcattgttgaattaaaacaggcccaaccttccttcttagcagtcgtttcgattgcttggttagcgccacaaaatcaaaaatttgtcgaagcgcaaggcaaagattacgccttggatagtgaacatttactttatagcgggccatttacgctagccaattgggatgcgacttcagatacttggacattgaaaaaaaatccagaatactatgatgcggatcaagtgaaactggaagaagttgcggttagcacaatcaaagaagataatactgggattaacttatatcaagtgaatgaactagacttagttcgcattaacggacaatatgttcaacaatatcaagatgatccaggctatgtcagtcatccagatgtggccaactacttcttagatttcaacaaaaaagaaggaacgccattagcgaatgttcatttacgaaaagcgattggccaagcaattgataaagaagccttaacacaaagtgtcttaaacgatgggtcaaaaccccttaacggattgattccaagtaaactttatgcgaatccagaaacggatgaagatttccgagcttacagtggcgaatatttgaaaaatgacgtcaaaaaagctcaagctgaatggacgaaagcccaagcggatgtcggtaaaaaagtgaaactttcattgctggcggcagacacagatcaaggaaaacgaattgctgaatatgttcaaagtcagttgcaagaaaatctgccaggtttagaaattaccatttcatcgcaaccaagtaataatgtgaaccaatcgcgacgtgaaaaaaattatgagttgtctctttcaggatggattgccggcagtagtgaattagactcttactttaacttatatgcaggagaatcaagttacaattacggcaattatcataatgccaaatacgaccaattggtagaagaggcacgaacgattaatgccaataatccagagaaacagtttgcagaatacaaagaagcggaagacatcttgttgaaccaagatgctgcccaagtaccgctgtatcaaagtgcctcaaattatctaatcaatcctaaattgaaaggcattagttatcacttgtatggggattatttccacttgcgcaatgcctatttaacagaatga

SEQ ID NO: 42 - protein, 547 aa
MKLGKKVVGLIATGFLLAACGGTKEAAEKVDSGNLAAEQKISISSPAPISTLDTTQTTDKNTFTMAQHLFEGLYRFDDDSATVPALAKDVKISDDGRKYHFTLREGIKWSNGEPITAQDFVYSWKKLVTPATIGPNAYLLDSVKNSFEIRNGEKSVDELGISAPNDKEFIVELKQAQPSFLAVVSIAWLAPQNQKFVEAQGKDYALDSEHLLYSGPFTLANWDATSDTWTLKKNPEYYDADQVKLEEVAVSTIKEDNTGINLYQVNELDLVRINGQYVQQYQDDPGYVSHPDVANYFLDFNKKEGTPLANVHLRKAIGQAIDKEALTQSVLNDGSKPLNGLIPSKLYANPETDEDFRAYSGEYLKNDVKKAQAEWTKAQADVGKKVKLSLLAADTDQGKRIAEYVQSQLQENLPGLEITISSQPSNNVNQSRREKNYELSLSGWIAGSSELDSYFNLYAGESSYNYGNYHNAKYDQLVEEARTINANNPEKQFAEYKEAEDILLNQDAAQVPLYQSASNYLINPKLKGISYHLYGDYFHLRNAYLTE

SEQ ID NO: 43 - DNA, 1585 bp; double-stranded, linear
atgtggcggaaccaaagaagcggcagagaaagtagattcgggaaatttagcagctgaacaaaaaatcagtattagttcacctgcaccaatctcaacattggatacaacacaaacaacagataaaaatacctttacaatggcacaacatttatttgaaggcctttatcggtttgatgatgatagtgccacggtgccagctctagctaaagatgtcaagattagtgacgatgggcgcaagtaccactttaccttgcgggaggggattaagtggagcaacggcgagccaatcacggcccaagattttgtttattcttggaaaaaactggtgacaccagcgacgattggaccgaatgcctatttactagacagtgttaaaaatagttttgaaatacgcaacggtgaaaagtcagtcgatgaattagggatttcagccccgaatgacaaagaattcattgttgaattaaaacaggcccaaccttccttcttagcagtcgtttcgattgcttggttagcgccacaaaatcaaaaatttgtcgaagcgcaaggcaaagattacgccttggatagtgaacatttactttatagcgggccatttacgctagccaattgggatgcgacttcagatacttggacattgaaaaaaaatccagaatactatgatgcggatcaagtgaaactggaagaagttgcggttagcacaatcaaagaagataatactgggattaacttatatcaagtgaatgaactagacttagttcgcattaacggacaatatgttcaacaatatcaagatgatccaggctatgtcagtcatccagatgtggccaactacttcttagatttcaacaaaaaagaaggaacgccattagcgaatgttcatttacgaaaagcgattggccaagcaattgataaagaagccttaacacaaagtgtcttaaacgatgggtcaaaaccccttaacggattgattccaagtaaactttatgcgaatccagaaacggatgaagatttccgagcttacagtggcgaatatttgaaaaatgacgtcaaaaaagctcaagctgaatggacgaaagcccaagcggatgtcggtaaaaaagtgaaactttcattgctggcggcagacacagatcaaggaaaacgaattgctgaatatgttcaaagtcagttgcaagaaaatctgccaggtttagaaattaccatttcatcgcaaccaagtaataatgtgaaccaatcgcgacgtgaaaaaaattatgagttgtctctttcaggatggattgccggcagtagtgaattagactcttactttaacttatatgcaggagaatcaagttacaattacggcaattatcataatgccaaatacgaccaattggtagaagaggcacgaacgattaatgccaataatccagagaaacagtttgcagaatacaaagaagcggaagacatcttgttgaaccaagatgctgcccaagtaccgctgtatcaaagtgcctcaaattatctaatcaatcctaaattgaaaggcattagttatcacttgtatggggattatttccacttgcgcaatgcctatttaacagaa

SEQ ID NO: 44 - protein, 528 aa
CGGTKEAAEKVDSGNLAAEQKISISSPAPISTLDTTQTTDKNTFTMAQHLFEGLYRFDDDSATVPALAKDVKISDDGRKYHFTLREGIKWSNGEPITAQDFVYSWKKLVTPATIGPNAYLLDSVKNSFEIRNGEKSVDELGISAPNDKEFIVELKQAQPSFLAVVSIAWLAPQNQKFVEAQGKDYALDSEHLLYSGPFTLANWDATSDTWTLKKNPEYYDADQVKLEEVAVSTIKEDNTGINLYQVNELDLVRINGQYVQQYQDDPGYVSHPDVANYFLDFNKKEGTPLANVHLRKAIGQAIDKEALTQSVLNDGSKPLNGLIPSKLYANPETDEDFRAYSGEYLKNDVKKAQAEWTKAQADVGKKVKLSLLAADTDQGKRIAEYVQSQLQENLPGLEITISSQPSNNVNQSRREKNYELSLSGWIAGSSELDSYFNLYAGESSYNYGNYHNAKYDQLVEEARTINANNPEKQFAEYKEAEDILLNQDAAQVPLYQSASNYLINPKLKGISYHLYGDYFHLRNAYLTE

SEQ ID NO: 45 - DNA, 795 bp; double-stranded, linear
taacgaaaaatgaaaaaaattgctttgttcagtatgttaacgttcagtgtattgtctttaagtctagcaggatgtggaaacaaaaaaacagcaagcacaaatgattctaagccaaagcaagaaacaaagaaagccacgcagaaatcctctagccaacaagaaatgaaaagtagtcattcgtctgtcacgggtcaaaattctaatgtgacaggggaaaatccgtcagaaaatgccacgcagccttctgcaggaactgatgaaacgaatgaagtccctcaaaaccaagcacctgatacaaacattacaattaccaatgttgttttcaatcctgaaagaaatgaaattaatggtactacattacctaatgcaaccattacagcaacggtagtcggtgatgcttctgcacaagcaggtgttttttatgcggatgccaatggcaattttacagtaattagtcccagagcgggagcgactactcaattaatcgcaaccgttgatcaacggaatagtgcacctgtccaaattgatattccaagttcaggacaagaagcagcgctttcttttagcaatattacgattgatccgaaacaagggacaatttctggtaaaacagcaccgaatgcaactattttagtgtcacgtgcagatgatgcgcgggtgattttagcaagttttactgcggatgcccaagggaatttcacagccagtaatttagttcccggcacaaaaaatcgcttagatgttacgttaaatggagaaatagggacaccttacttgtttgatttaccaaattaa

SEQ ID NO: 46 - protein, 261 aa
MKKIALFSMLTFSVLSLSLAGCGNKKTASTNDSKPKQETKKATQKSSSQQEMKSSHSSVTGQNSNVTGENPSENATQPSAGTDETNEVPQNQAPDTNITITNVVFNPERNEINGTTLPNATITATVVGDASAQAGVFYADANGNFTVISPRAGATTQLIATVDQRNSAPVQIDIPSSGQEAALSFSNITIDPKQGTISGKTAPNATILVSRADDARVILASFTADAQGNFTASNLVPGTKNRLDVTLNGEIGTPYLFDLPN

SEQ ID NO: 47 - DNA, 721 bp; double-stranded, linear
atgtggaaacaaaaaaacagcaagcacaaatgattctaagccaaagcaagaaacaaagaaagccacgcagaaatcctctagccaacaagaaatgaaaagtagtcattcgtctgtcacgggtcaaaattctaatgtgacaggggaaaatccgtcagaaaatgccacgcagccttctgcaggaactgatgaaacgaatgaagtccctcaaaaccaagcacctgatacaaacattacaattaccaatgttgttttcaatcctgaaagaaatgaaattaatggtactacattacctaatgcaaccattacagcaacggtagtcggtgatgcttctgcacaagcaggtgttttttatgcggatgccaatggcaattttacagtaattagtcccagagcgggagcgactactcaattaatcgcaaccgttgatcaacggaatagtgcacctgtccaaattgatattccaagttcaggacaagaagcagcgctttcttttagcaatattacgattgatccgaaacaagggacaatttctggtaaaacagcaccgaatgcaactattttagtgtcacgtgcagatgatgcgcgggtgattttagcaagttttactgcggatgcccaagggaatttcacagccagtaatttagttcccggcacaaaaaatcgcttagatgttacgttaaatggagaaatagggacaccttacttgtttgatttaccaaat

SEQ ID NO: 48 - protein, 240 aa
CGNKKTASTNDSKPKQETKKATQKSSSQQEMKSSHSSVTGQNSNVTGENPSENATQPSAGTDETNEVPQNQAPDTNITITNVVFNPERNEINGTTLPNATITATVVGDASAQAGVFYADANGNFTVISPRAGATTQLIATVDQRNSAPVQIDIPSSGQEAALSFSNITIDPKQGTISGKTAPNATILVSRADDARVILASFTADAQGNFTASNLVPGTKNRLDVTLNGEIGTPYLFDLPN

SEQ ID NO: 49 - DNA, 1164 bp; double-stranded, linear
tgatggtggagactttttaagagagaggaagtacagccaatgagtaggaagcgaaaaatcagcttaattagtttagtcatcattttggtttttgtcacagtcggctcagcatactttgctgtagcgggtagctatttaaagaaaacaattgataaaggctatgttcccataaaaaatgattataatgaagcgcaaaataaagatagtcaatcgtttttgattatggggctagacaatacaattgaacggaaattaggcacaactaggactgatgctatgatggtgattaccgtgaataacaagacgaagaaaataacctatttaagtttgccacgggatagttttgttcaaattgatgcgaaaaattaccaagggatgcagcgaattgaagccgcctatacctacgatggaccaacagcttctgttaacacagttgagaaattattgaatattccaatcaatcattacgttgtgtttaactttttatcttttattaagttaattgatgcggttggcggcatagatgtcaatgtcaagcaggcgtttgatggtgtcaccaaagacgggccaggatccattcattttgatgcagggaaacagcatttagatggtacgaaagctttatcttatgcccgtgaaagacatagcgataacgatattatgcgtggattccgacaacaagaaattattcaagcagttgaagacaagttgaaatctggtcaatcaatcatgaaaataatggacattattgattcgttaaatggaaacattcaaactgatgtggattccaatgaattgactcatttagtcaaagaaggtttgacttggaccaattatgataaacaacagctttcttttgactggcgcacttttagtaatgaagggcgcagtatggttgaactatacccagatagtattgaaaatgtccgtcatcaattacgtgtgtctttaaatttagaaaagccagatgaacgagatcaagacggctatgtcttccatacgaacggtgaatttttatatcaaagtgattataccgttcaagatgaagcagctgaggaaaacgaaatgacttccatcaacggcaatacgtatattggtgttcctggtaatacacagaccggcccgttgccatcagttaaaacggaaaatggctttataaaataa

SEQ ID NO: 50 - protein, 374 aa
MSRKRKISLISLVIILVFVTVGSAYFAVAGSYLKKTIDKGYVPIKNDYNEAQNKDSQSFLIMGLDNTIERKLGTTRTDAMMVITVNNKTKKITYLSLPRDSFVQIDAKNYQGMQRIEAAYTYDGPTASVNTVEKLLNIPINHYVVFNFLSFIKLIDAVGGIDVNVKQAFDGVTKDGPGSIHFDAGKQHLDGTKALSYARERHSDNDIMRGFRQQEIIQAVEDKLKSGQSIMKIMDIIDSLNGNIQTDVDSNELTHLVKEGLTWTNYDKQQLSFDWRTFSNEGRSMVELYPDSIENVRHQLRVSLNLEKPDERDQDGYVFHTNGEFLYQSDYTVQDEAAEENEMTSINGNTYIGVPGNTQTGPLPSVKTENGFIK

SEQ ID NO: 51 - DNA, 1045 bp; double-stranded, linear
tgctgtagcgggtagctatttaaagaaaacaattgataaaggctatgttcccataaaaaatgattataatgaagcgcaaaataaagatagtcaatcgtttttgattatggggctagacaatacaattgaacggaaattaggcacaactaggactgatgctatgatggtgattaccgtgaataacaagacgaagaaaataacctatttaagtttgccacgggatagttttgttcaaattgatgcgaaaaattaccaagggatgcagcgaattgaagccgcctatacctacgatggaccaacagcttctgttaacacagttgagaaattattgaatattccaatcaatcattacgttgtgtttaactttttatcttttattaagttaattgatgcggttggcggcatagatgtcaatgtcaagcaggcgtttgatggtgtcaccaaagacgggccaggatccattcattttgatgcagggaaacagcatttagatggtacgaaagctttatcttatgcccgtgaaagacatagcgataacgatattatgcgtggattccgacaacaagaaattattcaagcagttgaagacaagttgaaatctggtcaatcaatcatgaaaataatggacattattgattcgttaaatggaaacattcaaactgatgtggattccaatgaattgactcatttagtcaaagaaggtttgacttggaccaattatgataaacaacagctttcttttgactggcgcacttttagtaatgaagggcgcagtatggttgaactatacccagatagtattgaaaatgtccgtcatcaattacgtgtgtctttaaatttagaaaagccagatgaacgagatcaagacggctatgtcttccatacgaacggtgaatttttatatcaaagtgattataccgttcaagatgaagcagctgaggaaaacgaaatgacttccatcaacggcaatacgtatattggtgttcctggtaatacacagaccggcccgttgccatcagttaaaacggaaaatggctttataaaa

SEQ ID NO: 52 - protein, 348 aa
AVAGSYLKKTIDKGYVPIKNDYNEAQNKDSQSFLIMGLDNTIERKLGTTRTDAMMVITVNNKTKKITYLSLPRDSFVQIDAKNYQGMQRIEAAYTYDGPTASVNTVEKLLNIPINHYVVFNFLSFIKLIDAVGGIDVNVKQAFDGVTKDGPGSIHFDAGKQHLDGTKALSYARERHSDNDIMRGFRQQEIIQAVEDKLKSGQSIMKIMDIIDSLNGNIQTDVDSNELTHLVKEGLTWTNYDKQQLSFDWRTFSNEGRSMVELYPDSIENVRHQLRVSLNLEKPDERDQDGYVFHTNGEFLYQSDYTVQDEAAEENEMTSINGNTYIGVPGNTQTGPLPSVKTENGFIK

SEQ ID NO: 53 - DNA, 414 bp; double-stranded, linear
taattaaaaatgtgtaaaaagggtctgatgaaaaaaggagacataatagttattatctttttaatagctatctctttttctccatattttattttttttcacaataatccatttaactccaaaagttttgacgacactaaatatgctgtggtcaagatagatgggaaagagattgagcgtataaatttagatgattcaaaagaatttatcaaaacatattatccatcaaaagggcaatataatactatagaagttaaaaatgggcacgttcgtgtaaaaaaagataatagtccagatcaaattgcggtgaaaacaggatggatatcagaaccagggcnaactagtatctgtattcctcacagattcattttagaaattgttcaacaatattctaaggattattatatttactaa

SEQ ID NO: 54 - protein, 128 aa
MKKGDIIVIIFLIAISFSPYFIFFHNNPFNSKSFDDTKYAVVKIDGKEIERINLDDSKEFIKTYYPSKGQYNTIEVKNGHVRVKKDNSPDQIAVKTGWISEPGXTSICIPHRFILEIVQQYSKDYYIY

SEQ ID NO: 55 - DNA, 310 bp; double-stranded, linear
caataatccatttaactccaaaagttttgacgacactaaatatgctgtggtcaagatagatgggaaagagattgagcgtataaatttagatgattcaaaagaatttatcaaaacatattatccatcaaaagggcaatataatactatagaagttaaaaatgggcacgttcgtgtaaaaaaagataatagtccagatcaaattgcggtgaaaacaggatggatatcagaaccagggcnaactagtatctgtattcctcacagattcattttagaaattgttcaacaatattctaaggattattatatttac

SEQ ID NO: 56 - protein, 103 aa
NNPFNSKSFDDTKYAVVKIDGKEIERINLDDSKEFIKTYYPSKGQYNTIEVKNGHVRVKKDNSPDQIAVKTGWISEPGXTSICIPHRFILEIVQQYSKDYYIY

SEQ ID NO: 57 - DNA, 867 bp; double-stranded, linear
tgacggttgcccccgtccaatagaaaggagtttatgatgaaaaagaaatattctttagccttgctggttatctgttgtagtttactcctatttgcaggttgtggtaaaagaaaaagcaacgaagatcaatggacacggattaacgaagaaaaacggattattattggcttagatgactcctttgtgcccatgggttttcaagataaatcaggcaaaattgtcggctttgatgtcgacttagccaaagcggtttttaaactttatggcatttccgttgacttccaaccgattgattggtctatgaaagaaacagaattacaaaatcaaaccattgatcttatttggaacggctacactaaaacgagcgagcgggccgaaaaagttcaattcacacaaccttacatgacgaacgaccaagtacttgtttctttaaaagaaaaaaacattgcaacagcgagcgacatgcaaggcaaaattttaggggttcaaaacggctcttctggctatgatggcttcgaaagtcagcctgacgttttgaaaaaatttgttaaagaccaaacacctattttatatgacggctttaatgaagctttcttagatttaaaatctggtcgaattgacggactcctaatcgatcgcgtttacgccaactactatctttcccacgaagataatttaaaaaactatactatttctcatgtaggctatgacaatgaagattttgctgtgggcgtccgcaaatcagacaatcaattagtccaaaaaatcaatactgcctttgaaacgttacgaaaagatggcacccttagtaaaatttctcaaaaatggtttggagaggacgttacaaataacacaaaaataaactaa

SEQ ID NO: 58 - protein, 277 aa
MMKKKYSLALLVICCSLLLFAGCGKRKSNEDQWTRINEEKRIIIGLDDSFVPMGFQDKSGKIVGFDVDLAKAVFKLYGISVDFQPIDWSMKETELQNQTIDLIWNGYTKTSERAEKVQFTQPYMTNDQVLVSLKEKNIATASDMQGKILGVQNGSSGYDGFESQPDVLKKFVKDQTPILYDGFNEAFLDLKSGRIDGLLIDRVYANYYLSHEDNLKNYTISHVGYDNEDFAVGVRKSDNQLVQKINTAFETLRKDGTLSKISQKWFGEDVTNNTKIN

SEQ ID NO: 59 - DNA, 751 bp; double-stranded, linear
aagcaacgaagatcaatggacacggattaacgaagaaaaacggattattattggcttagatgactcctttgtgcccatgggttttcaagataaatcaggcaaaattgtcggctttgatgtcgacttagccaaagcggtttttaaactttatggcatttccgttgacttccaaccgattgattggtctatgaaagaaacagaattacaaaatcaaaccattgatcttatttggaacggctacactaaaacgagcgagcgggccgaaaaagttcaattcacacaaccttacatgacgaacgaccaagtacttgtttctttaaaagaaaaaaacattgcaacagcgagcgacatgcaaggcaaaattttaggggttcaaaacggctcttctggctatgatggcttcgaaagtcagcctgacgttttgaaaaaatttgttaaagaccaaacacctattttatatgacggctttaatgaagctttcttagatttaaaatctggtcgaattgacggactcctaatcgatcgcgtttacgccaactactatctttcccacgaagataatttaaaaaactatactatttctcatgtaggctatgacaatgaagattttgctgtgggcgtccgcaaatcagacaatcaattagtccaaaaaatcaatactgcctttgaaacgttacgaaaagatggcacccttagtaaaatttctcaaaaatggtttggagaggacgttacaaataacacaaaaataaac

SEQ ID NO: 60 - protein, 250 aa
SNEDQWTRINEEKRIIIGLDDSFVPMGFQDKSGKIVGFDVDLAKAVFKLYGISVDFQPIDWSMKETELQNQTIDLIWNGYTKTSERAEKVQFTQPYMTNDQVLVSLKEKNIATASDMQGKILGVQNGSSGYDGFESQPDVLKKFVKDQTPILYDGFNEAFLDLKSGRIDGLLIDRVYANYYLSHEDNLKNYTISHVGYDNEDFAVGVRKSDNQLVQKINTAFETLRKDGTLSKISQKWFGEDVTNNTKIN

SEQ ID NO: 61 - DNA, 1641 bp; double-stranded, linear
tgaggtgtttttatgaaaagggcaacaaagcaaaggctgtctttggcagcaatcatggttctacttctctcgggctgtggaagtgttgggaaagaaaccaaaaagcaagaacaacaggtattacgggtcgggattgattcggaattatcaacggcagacgtgtcgttggcaatggataataccgcagcagatgtaatgagccaagtaggggagggacttttctcctttgacgaaaaaggagaagcgaaaccagcattggcaactgaaaaagtacagccctccaatgatggtttaagctatacttttacgattcgaaaagatgcaaaatggagtaacggcgagccaatcacagcaaatgattttgaatactcttggaagcgcacagtggacccaaaaacagcttccccgcaagcgtattactttgaagggttaaaaaattatcgtgctattgttgacggtagcaaatctaaagaagagttaggggtaacagccattgatgaccataccttggaagtagagctaagctatcctatgagttattttcaacaattattggcggtaccagctttttatcctttaaatgaagcatttgtcgaaaaaacgggcaaaaactatggtacatcagctgagtcaacactttacaatggcgccttcacattagaaggttgggatggcacgaataatacttggtcctatgtgaagaataaaaattattgggatcaagcgaatgtttcgctagataaggtggatgtccaagtagttaaagaagtcaatactgggaaaaatcttttcgaagggaaagaattagatgttgtaaaaatttctggagaaattgttgcacaagaacaaggcaatgcagctttgaaaattcgtgaaattcctggaacgtattatatccaattaaatacgcaaaaagatcttttggcaaataagaatgcacgtcgagcaatagcattatcattgaattctgagcgtttagctaaaaatgttttaaatgatggctcaaaaaaagcacttggcttcgtgccaacaggtttcactaatcaagaaacgcaaaaagattttgcagaggaattaggagatttaaatcctagtgaaccagaaaaagcgaaagagttatggcaaacggctaaaaaagaattaggaattgaaaaagcggagctaacgattttaagttcggatacagaaaatgctaaaaaaatcagtgagtatgttcaaggagctttagcagataatttagaaaatttaacagtcaatgtttcaccagttccttttaataatcgtttagaaaaaagtcgcagcggagatttcgacattgtggttggtggctggacgccagtatatgctgatccaatcgatttcttaaacttactgcaatcaaaaaattccaataattttggtaaatggtctaataagacctttgatcagttgcttcaagaagcaaacgtaacttatgcaaataaatatgaagaacgttggaaaacattacaaaaagcggatcaattggttgcggaagaagcccccctagttcctctttatcaattaacagaagcacgcttagtggccgattctgtccaaaatttagtctatggtccattaggttcaggctattacaaatcagtctctatcggcgacaagtaa

SEQ ID NO: 62 - protein, 542 aa
MKRATKQRLSLAAIMVLLLSGCGSVGKETKKQEQQVLRVGIDSELSTADVSLAMDNTAADVMSQVGEGLFSFDEKGEAKPALATEKVQPSNDGLSYTFTIRKDAKWSNGEPITANDFEYSWKRTVDPKTASPQAYYFEGLKNYRAIVDGSKSKEELGVTAIDDHTLEVELSYPMSYFQQLLAVPAFYPLNEAFVEKTGKNYGTSAESTLYNGAFTLEGWDGTNNTWSYVKNKNYWDQANVSLDKVDVQVVKEVNTGKNLFEGKELDVVKISGEIVAQEQGNAALKIREIPGTYYIQLNTQKDLLANKNARRAIALSLNSERLAKNVLNDGSKKALGFVPTGFTNQETQKDFAEELGDLNPSEPEKAKELWQTAKKELGIEKAELTILSSDTENAKKISEYVQGALADNLENLTVNVSPVPFNNRLEKSRSGDFDIVVGGWTPVYADPIDFLNLLQSKNSNNFGKWSNKTFDQLLQEANVTYANKYEERWKTLQKADQLVAEEAPLVPLYQLTEARLVADSVQNLVYGPLGSGYYKSVSIGDK

SEQ ID NO: 63 - DNA, 1564 bp; double-stranded, linear
ctgtggaagtgttgggaaagaaaccaaaaagcaagaacaacaggtattacgggtcgggattgattcggaattatcaacggcagacgtgtcgttggcaatggataataccgcagcagatgtaatgagccaagtaggggagggacttttctcctttgacgaaaaaggagaagcgaaaccagcattggcaactgaaaaagtacagccctccaatgatggtttaagctatacttttacgattcgaaaagatgcaaaatggagtaacggcgagccaatcacagcaaatgattttgaatactcttggaagcgcacagtggacccaaaaacagcttccccgcaagcgtattactttgaagggttaaaaaattatcgtgctattgttgacggtagcaaatctaaagaagagttaggggtaacagccattgatgaccataccttggaagtagagctaagctatcctatgagttattttcaacaattattggcggtaccagctttttatcctttaaatgaagcatttgtcgaaaaaacgggcaaaaactatggtacatcagctgagtcaacactttacaatggcgccttcacattagaaggttgggatggcacgaataatacttggtcctatgtgaagaataaaaattattgggatcaagcgaatgtttcgctagataaggtggatgtccaagtagttaaagaagtcaatactgggaaaaatcttttcgaagggaaagaattagatgttgtaaaaatttctggagaaattgttgcacaagaacaaggcaatgcagctttgaaaattcgtgaaattcctggaacgtattatatccaattaaatacgcaaaaagatcttttggcaaataagaatgcacgtcgagcaatagcattatcattgaattctgagcgtttagctaaaaatgttttaaatgatggctcaaaaaaagcacttggcttcgtgccaacaggtttcactaatcaagaaacgcaaaaagattttgcagaggaattaggagatttaaatcctagtgaaccagaaaaagcgaaagagttatggcaaacggctaaaaaagaattaggaattgaaaaagcggagctaacgattttaagttcggatacagaaaatgctaaaaaaatcagtgagtatgttcaaggagctttagcagataatttagaaaatttaacagtcaatgtttcaccagttccttttaataatcgtttagaaaaaagtcgcagcggagatttcgacattgtggttggtggctggacgccagtatatgctgatccaatcgatttcttaaacttactgcaatcaaaaaattccaataattttggtaaatggtctaataagacctttgatcagttgcttcaagaagcaaacgtaacttatgcaaataaatatgaagaacgttggaaaacattacaaaaagcggatcaattggttgcggaagaagcccccctagttcctctttatcaattaacagaagcacgcttagtggccgattctgtccaaaatttagtctatggtccattaggttcaggctattacaaatcagtctctatcggcgacaag

SEQ ID NO: 64 - protein, 521 aa
CGSVGKETKKQEQQVLRVGIDSELSTADVSLAMDNTAADVMSQVGEGLFSFDEKGEAKPALATEKVQPSNDGLSYTFTIRKDAKWSNGEPITANDFEYSWKRTVDPKTASPQAYYFEGLKNYRAIVDGSKSKEELGVTAIDDHTLEVELSYPMSYFQQLLAVPAFYPLNEAFVEKTGKNYGTSAESTLYNGAFTLEGWDGTNNTWSYVKNKNYWDQANVSLDKVDVQVVKEVNTGKNLFEGKELDVVKISGEIVAQEQGNAALKIREIPGTYYIQLNTQKDLLANKNARRAIALSLNSERLAKNVLNDGSKKALGFVPTGFTNQETQKDFAEELGDLNPSEPEKAKELWQTAKKELGIEKAELTILSSDTENAKKISEYVQGALADNLENLTVNVSPVPFNNRLEKSRSGDFDIVVGGWTPVYADPIDFLNLLQSKNSNNFGKWSNKTFDQLLQEANVTYANKYEERWKTLQKADQLVAEEAPLVPLYQLTEARLVADSVQNLVYGPLGSGYYKSVSIGDK

SEQ ID NO: 65 - DNA, 1707 bp; double-stranded, linear
tgtcattacaacgataccaattttaatcatttatccattactacaaaaacactttatcggcggtatgatggccggtgcagtaaaagaataaagaaagtagggaacaatatgaaaaaagttttaggcggtttattggtggcaacggcggtcgttagtttagcggcctgtagcggtggggaaaagaaagctagctcagatgtctcaattaaggatcggtatgaattagatgaaaagacgcctgcttggaagttagataagaagaaagaaccgaccaagattaaatggtatattaactcagattggacggcgctgccttttggaaaagacgtgaccactgcgcagattaaaaaagacttaaatgtggatattgaatttatttccggcgatgattcaaaattaaatgccatgatttcaagtggagatatgcctgatatcgtgacattaactgaaaaaactggacaagcagcattgaaagcagattcttgggcctattctttaaacgatttagctaaaaaatatgacccctatttaatgaaagttgttaaccaagatacgtttaaatggtatgccttagaggatggaaaaacatatggttaccctaattactctaatacaaaagcggattatgaaagtggaaatatcccagtaaatgataattttgttattcgtgaagatgtctataatgcattaggcaagccagacgtttcaacaccagaaaattttgaaaaagtcatgcaacagattaaagaaaaatatcctgagatgaccccaatgggcttcaccacagtgggcgatggtgcaggaccatttttagacaaattacaagacttcttaggtgttcctttagaggataaaaatggtaaatactatgatcgaaatttagataaagaatatttagaatggttaaaaacatttaatgatgtttaccgagcaggcaatattagtgatgatagcttcacagatgatggggcaacgtttgatgaaaaagtgaaacaaggaaattatgcaaccatgctcgttgctggaaccagtggtcaaggtgggaacttcacagaatttatgaaaaaatctggcacacgttatatagccattgatggaccaagtagcacttctggccgaaaaccaacattaaatcaaaccggcatttcaggttggttaagtaattacattacgaaagatgcgaaagatccagcaaaagtcactcaactgttcacatatttaattgatgaaccgggacaaattttaacaaaatatggcgttgaaggagttacttatgcgtacaatgatcaaggaaaaattgattatttaccagaagtgaaaaaattagaacaaacagacaatgatgcctacaacaaaaaatatggcattagtcgtttcctatactttaacaacgaccgtgtcaataaactaaaagtaccaatggaaagtgctttaacgcaaatgcaagaatggggcaaaggaaaattagtcccacatttcgtaattgaaaatattaatccagatgcaggaacgccggaagctcgtgcgaatgaagcgattgaaaccaaactaaatacaaccgttatttcaatgattcgtgcgaaagatgataaagcctttgacaaatctttagaagactacaaagcattcttaaaatcaaataaatgggatgcaattgaaaaaataaaatctgagaaaatggcggaaaacagagacaaacttaagtaa

SEQ ID NO: 66 - protein, 532 aa
MKKVLGGLLVATAVVSLAACSGGEKKASSDVSIKDRYELDEKTPAWKLDKKKEPTKIKWYINSDWTALPFGKDVTTAQIKKDLNVDIEFISGDDSKLNAMISSGDMPDIVTLTEKTGQAALKADSWAYSLNDLAKKYDPYLMKVVNQDTFKWYALEDGKTYGYPNYSNTKADYESGNIPVNDNFVIREDVYNALGKPDVSTPENFEKVMQQIKEKYPEMTPMGFTTVGDGAGPFLDKLQDFLGVPLEDKNGKYYDRNLDKEYLEWLKTFNDVYRAGNISDDSFTDDGATFDEKVKQGNYATMLVAGTSGQGGNFTEFMKKSGTRYIAIDGPSSTSGRKPTLNQTGISGWLSNYITKDAKDPAKVTQLFTYLIDEPGQILTKYGVEGVTYAYNDQGKIDYLPEVKKLEQTDNDAYNKKYGISRFLYFNNDRVNKLKVPMESALTQMQEWGKGKLVPHFVIENINPDAGTPEARANEAIETKLNTTVISMIRAKDDKAFDKSLEDYKAFLKSNKWDAIEKIKSEKMAENRDKLK

SEQ ID NO: 67 - DNA, 1540 bp; double-stranded, linear
ctgtagcggtggggaaaagaaagctagctcagatgtctcaattaaggatcggtatgaattagatgaaaagacgcctgcttggaagttagataagaagaaagaaccgaccaagattaaatggtatattaactcagattggacggcgctgccttttggaaaagacgtgaccactgcgcagattaaaaaagacttaaatgtggatattgaatttatttccggcgatgattcaaaattaaatgccatgatttcaagtggagatatgcctgatatcgtgacattaactgaaaaaactggacaagcagcattgaaagcagattcttgggcctattctttaaacgatttagctaaaaaatatgacccctatttaatgaaagttgttaaccaagatacgtttaaatggtatgccttagaggatggaaaaacatatggttaccctaattactctaatacaaaagcggattatgaaagtggaaatatcccagtaaatgataattttgttattcgtgaagatgtctataatgcattaggcaagccagacgtttcaacaccagaaaattttgaaaaagtcatgcaacagattaaagaaaaatatcctgagatgaccccaatgggcttcaccacagtgggcgatggtgcaggaccatttttagacaaattacaagacttcttaggtgttcctttagaggataaaaatggtaaatactatgatcgaaatttagataaagaatatttagaatggttaaaaacatttaatgatgtttaccgagcaggcaatattagtgatgatagcttcacagatgatggggcaacgtttgatgaaaaagtgaaacaaggaaattatgcaaccatgctcgttgctggaaccagtggtcaaggtgggaacttcacagaatttatgaaaaaatctggcacacgttatatagccattgatggaccaagtagcacttctggccgaaaaccaacattaaatcaaaccggcatttcaggttggttaagtaattacattacgaaagatgcgaaagatccagcaaaagtcactcaactgttcacatatttaattgatgaaccgggacaaattttaacaaaatatggcgttgaaggagttacttatgcgtacaatgatcaaggaaaaattgattatttaccagaagtgaaaaaattagaacaaacagacaatgatgcctacaacaaaaaatatggcattagtcgtttcctatactttaacaacgaccgtgtcaataaactaaaagtaccaatggaaagtgctttaacgcaaatgcaagaatggggcaaaggaaaattagtcccacatttcgtaattgaaaatattaatccagatgcaggaacgccggaagctcgtgcgaatgaagcgattgaaaccaaactaaatacaaccgttatttcaatgattcgtgcgaaagatgataaagcctttgacaaatctttagaagactacaaagcattcttaaaatcaaataaatgggatgcaattgaaaaaataaaatctgagaaaatggcggaaaacagagacaaacttaag

SEQ ID NO: 68 - protein, 513 aa
CSGGEKKASSDVSIKDRYELDEKTPAWKLDKKKEPTKIKWYINSDWTALPFGKDVTTAQIKKDLNVDIEFISGDDSKLNAMISSGDMPDIVTLTEKTGQAALKADSWAYSLNDLAKKYDPYLMKVVNQDTFKWYALEDGKTYGYPNYSNTKADYESGNIPVNDNFVIREDVYNALGKPDVSTPENFEKVMQQIKEKYPEMTPMGFTTVGDGAGPFLDKLQDFLGVPLEDKNGKYYDRNLDKEYLEWLKTFNDVYRAGNISDDSFTDDGATFDEKVKQGNYATMLVAGTSGQGGNFTEFMKKSGTRYIAIDGPSSTSGRKPTLNQTGISGWLSNYITKDAKDPAKVTQLFTYLIDEPGQILTKYGVEGVTYAYNDQGKIDYLPEVKKLEQTDNDAYNKKYGISRFLYFNNDRVNKLKVPMESALTQMQEWGKGKLVPHFVIENINPDAGTPEARANEAIETKLNTTVISMIRAKDDKAFDKSLEDYKAFLKSNKWDAIEKIKSEKMAENRDKLK

SEQ ID NO: 69 - DNA, 954 bp; double-stranded, linear
taaaggagttacacaatgaaacttttaaaaaagacggtcctaattggtacaacccttcttcttggttcattcttactcgcagcttgtggtaatacgaataaagaagccaacaacgctgacaaaacacatgaagtaacagataccttaggcaataaagtaaccgtccccgcgaaacccaaacggattattgcgagttatttagaagattatctagttgcattaggagaaaaaccagtggcacaatggacagttggacaaggcagcattcaagattatttagcgaaagaattgaaagatgtccccactatttcctatgacttgccatatgaagcggttctaaaatttgaacctgacttattattaatcagttcatctgctctagttgaaggcggtaaatacaaagaatacagtaaaattgcgccaacttatgtagtcaaaaacggcgaaaatgtcacctggcgtgatcaattggaagatattgccactgttttagataaaaaagaacaagcgaaaaaagtgttagaagattatgataccttaaccaaaggcgtccaagaatatcttggcaaaaaagatgctggcaaatctgcggcagtcttatgggtaaccaacaaccaagtctttatggttagcgataatcgctcaagcggaaccgtgctctatcaggacttaggcctccaagttccaaaattagtggaagaaatttctaaaaacgctactgcggattggaatcaagtttctttagaaaaattagctgagcttgacgcagaccacattttccttgtaaacagcgatgaatcagcacctcttttccaagaagcaatttggaagaacttacctgctgtgaaaaataaccaagttcatacctatgataaaaaaagtagttggttatacaacggacctattgcgaatactcaaattgttgaagatgtaaaaaaagcgctcttaaattaa

SEQ ID NO: 70 - protein, 312 aa
MKLLKKTVLIGTTLLLGSFLLAACGNTNKEANNADKTHEVTDTLGNKVTVPAKPKRIIASYLEDYLVALGEKPVAQWTVGQGSIQDYLAKELKDVPTISYDLPYEAVLKFEPDLLLISSSALVEGGKYKEYSKIAPTYVVKNGENVTWRDQLEDIATVLDKKEQAKKVLEDYDTLTKGVQEYLGKKDAGKSAAVLWVTNNQVFMVSDNRSSGTVLYQDLGLQVPKLVEEISKNATADWNQVSLEKLAELDADHIFLVNSDESAPLFQEAIWKNLPAVKNNQVHTYDKKSSWLYNGPIANTQIVEDVKKALLN

SEQ ID NO: 71 - DNA, 868 bp; double-stranded, linear
ttgtggtaatacgaataaagaagccaacaacgctgacaaaacacatgaagtaacagataccttaggcaataaagtaaccgtccccgcgaaacccaaacggattattgcgagttatttagaagattatctagttgcattaggagaaaaaccagtggcacaatggacagttggacaaggcagcattcaagattatttagcgaaagaattgaaagatgtccccactatttcctatgacttgccatatgaagcggttctaaaatttgaacctgacttattattaatcagttcatctgctctagttgaaggcggtaaatacaaagaatacagtaaaattgcgccaacttatgtagtcaaaaacggcgaaaatgtcacctggcgtgatcaattggaagatattgccactgttttagataaaaaagaacaagcgaaaaaagtgttagaagattatgataccttaaccaaaggcgtccaagaatatcttggcaaaaaagatgctggcaaatctgcggcagtcttatgggtaaccaacaaccaagtctttatggttagcgataatcgctcaagcggaaccgtgctctatcaggacttaggcctccaagttccaaaattagtggaagaaatttctaaaaacgctactgcggattggaatcaagtttctttagaaaaattagctgagcttgacgcagaccacattttccttgtaaacagcgatgaatcagcacctcttttccaagaagcaatttggaagaacttacctgctgtgaaaaataaccaagttcatacctatgataaaaaaagtagttggttatacaacggacctattgcgaatactcaaattgttgaagatgtaaaaaaagcgctcttaaat

SEQ ID NO: 72 - protein, 289 aa
CGNTNKEANNADKTHEVTDTLGNKVTVPAKPKRIIASYLEDYLVALGEKPVAQWTVGQGSIQDYLAKELKDVPTISYDLPYEAVLKFEPDLLLISSSALVEGGKYKEYSKIAPTYVVKNGENVTWRDQLEDIATVLDKKEQAKKVLEDYDTLTKGVQEYLGKKDAGKSAAVLWVTNNQVFMVSDNRSSGTVLYQDLGLQVPKLVEEISKNATADWNQVSLEKLAELDADHIFLVNSDESAPLFQEAIWKNLPAVKNNQVHTYDKKSSWLYNGPIANTQIVEDVKKALLN

SEQ ID NO: 73 - DNA, 375 bp; double-stranded, linear
tgaggagatgagaaaatgaaaaaggtagtttcaattttgttgatggttgttgcagtcttcacattaactgcatgtaatggttctaaattagataaaacaggtgaagaatttaaaaattctataatgaaagattcttcatatggtgatgaatattcagaagatggttttagttttttaatatataaagataaagacactaatcgttatttggctgatgtttgggttcctgttaaagatgaaactagcgcattggagtatttttattattatgatgaagataagcgattagatagtactaaaagtaaagtaacctttgatgatatgaaagctagtggaaactatgaagtagtgtataaatcagggaaatttaaataa

SEQ ID NO: 74 - protein, 119 aa
MKKVVSILLMVVAVFTLTACNGSKLDKTGEEFKNSIMKDSSYGDEYSEDGFSFLIYKDKDTNRYLADVWVPVKDETSALEYFYYYDEDKRLDSTKSKVTFDDMKASGNYEVVYKSGKFK

SEQ ID NO: 75 - DNA, 301 bp; double-stranded, linear
atgtaatggttctaaattagataaaacaggtgaagaatttaaaaattctataatgaaagattcttcatatggtgatgaatattcagaagatggttttagttttttaatatataaagataaagacactaatcgttatttggctgatgtttgggttcctgttaaagatgaaactagcgcattggagtatttttattattatgatgaagataagcgattagatagtactaaaagtaaagtaacctttgatgatatgaaagctagtggaaactatgaagtagtgtataaatcagggaaatttaaa

SEQ ID NO: 76 - protein, 100 aa
CNGSKLDKTGEEFKNSIMKDSSYGDEYSEDGFSFLIYKDKDTNRYLADVWVPVKDETSALEYFYYYDEDKRLDSTKSKVTFDDMKASGNYEVVYKSGKFK

SEQ ID NO: 77 - DNA, 1131 bp; double-stranded, linear
tagttgtttaaatacattaaactatttttaggaggctttacagaaatgaaaaaagcaaaattattcggttttagtttgattgcattaggtttatcagtttcacttgcagcatgtggtggtggcaaaggcaaaaccgctgaaagcggcggtggcaaaggggatgcagcgcatagtgctgtaatcattacagatacaggcggcgtggatgacaagtcgttcaaccaatcttcttgggaaggattgcaagcttggggtaaagaacatgatttaccagaaggttcaaaagggtatgcatatattcaatcgaatgatgcagctgactatacaaccaatattgaccaagcggtatcaagtaaattcaacacaatctttggtattggctacttgctaaaagatgcaatttcttctgcagcagatgccaaccctgatacaaactttgttttaatcgatgatcaaatcgatggcaaaaagaatgtcgtttctgcaacatttagagataatgaagcagcttacttagccggtgttgctgctgcaaatgaaacaaaaacgaacaaagtcggttttgttggtggtgaagaaggggtcgtaattgaccgtttccaagctggttttgaaaaaggtgtggctgatgctgcgaaagaattaggtaaagaaattactgttgatacgaaatatgcggcttcatttgctgatcctgccaaagggaaagctttagctgctgcaatgtaccaaaacggcgttgatatcatcttccatgcttctggtgcgactggacaaggggtcttccaagaagcaaaagacttgaatgaatcaggttctggcgacaaagtttgggtaatcggcgttgaccgcgatcaagatgctgatggcaagtacaaaacaaaagacggcaaagaagacaacttcacgttaacttcaacgcttaaaggtgtcggcacagcggttcaagatattgccaaccgtgcgttagaagacaaattccctggtggcgaacatttagtttatggattaaaagatggtggcgttgacttaacagacggctatttaaacgacaaaacaaaagaagctgttaaaacagcaaaagataaagtaatctcaggtgacgtaaaagtcccagaaaaaccagaataa

SEQ ID NO: 78 - protein, 361 aa
MKKAKLFGFSLIALGLSVSLAACGGGKGKTAESGGGKGDAAHSAVIITDTGGVDDKSFNQSSWEGLQAWGKEHDLPEGSKGYAYIQSNDAADYTTNIDQAVSSKFNTIFGIGYLLKDAISSAADANPDTNFVLIDDQIDGKKNVVSATFRDNEAAYLAGVAAANETKTNKVGFVGGEEGVVIDRFQAGFEKGVADAAKELGKEITVDTKYAASFADPAKGKALAAAMYQNGVDIIFHASGATGQGVFQEAKDLNESGSGDKVWVIGVDRDQDADGKYKTKDGKEDNFTLTSTLKGVGTAVQDIANRALEDKFPGGEHLVYGLKDGGVDLTDGYLNDKTKEAVKTAKDKVISGDVKVPEKPE

SEQ ID NO: 79 - DNA, 1018 bp; double-stranded, linear
atgtggtggtggcaaaggcaaaaccgctgaaagcggcggtggcaaaggggatgcagcgcatagtgctgtaatcattacagatacaggcggcgtggatgacaagtcgttcaaccaatcttcttgggaaggattgcaagcttggggtaaagaacatgatttaccagaaggttcaaaagggtatgcatatattcaatcgaatgatgcagctgactatacaaccaatattgaccaagcggtatcaagtaaattcaacacaatctttggtattggctacttgctaaaagatgcaatttcttctgcagcagatgccaaccctgatacaaactttgttttaatcgatgatcaaatcgatggcaaaaagaatgtcgtttctgcaacatttagagataatgaagcagcttacttagccggtgttgctgctgcaaatgaaacaaaaacgaacaaagtcggttttgttggtggtgaagaaggggtcgtaattgaccgtttccaagctggttttgaaaaaggtgtggctgatgctgcgaaagaattaggtaaagaaattactgttgatacgaaatatgcggcttcatttgctgatcctgccaaagggaaagctttagctgctgcaatgtaccaaaacggcgttgatatcatcttccatgcttctggtgcgactggacaaggggtcttccaagaagcaaaagacttgaatgaatcaggttctggcgacaaagtttgggtaatcggcgttgaccgcgatcaagatgctgatggcaagtacaaaacaaaagacggcaaagaagacaacttcacgttaacttcaacgcttaaaggtgtcggcacagcggttcaagatattgccaaccgtgcgttagaagacaaattccctggtggcgaacatttagtttatggattaaaagatggtggcgttgacttaacagacggctatttaaacgacaaaacaaaagaagctgttaaaacagcaaaagataaagtaatctcaggtgacgtaaaagtcccagaaaaaccagaa

SEQ ID NO: 80 - protein, 339 aa
CGGGKGKTAESGGGKGDAAHSAVIITDTGGVDDKSFNQSSWEGLQAWGKEHDLPEGSKGYAYIQSNDAADYTTNIDQAVSSKFNTIFGIGYLLKDAISSAADANPDTNFVLIDDQIDGKKNVVSATFRDNEAAYLAGVAAANETKTNKVGFVGGEEGVVIDRFQAGFEKGVADAAKELGKEITVDTKYAASFADPAKGKALAAAMYQNGVDIIFHASGATGQGVFQEAKDLNESGSGDKVWVIGVDRDQDADGKYKTKDGKEDNFTLTSTLKGVGTAVQDIANRALEDKFPGGEHLVYGLKDGGVDLTDGYLNDKTKEAVKTAKDKVISGDVKVPEKPE

SEQ ID NO: 81 - DNA, 1680 bp; double-stranded, linear
taagagcataaaaaaatgaagagttataggagaaagaagatgaaaaagtatttaaaaatcacaatggtttgtattttattggtaggatttttagctgggtgtaccaataaaaatgaaaataaaaagaaacagaaaaataccaaagaagccgttcaactgatgtcaccctcggaattaacaacgctcaacacctctgtattattggattttccagatgctattgtccaaactgcagcgtttgaagggttatatagtttagatgaacaagaccaattggtaccagccgtagcaaaagcattgccgatgatttcagaagatggaaaaacctacacgatttctttgagaaaagaagcggtttggagtaacgatgatcctgtcacagcacatgattttgaatatgcttggaaaaaaatgattgatcctaaaaacggctttgtttatagcttcctcatcgttgaaacaattcaaaatggtgcagaaatctcagcggggaaattagcacccaatgaactaggtgtcacagctgtggatgattatacattaaaggtgacgctcaaagagccaaaaccgtactttacgtccttgttagcttttccgacatttttcccgcaaaatcnaaaagtagtcgaacaatttggtgcggactatggaactgctagtgataaagtcgtctataatggtccgttcgtggtaaaagattggcagcaaacaaagatggactggcaactagcaaaaaataatcgctattgggatcaccagaacgtgcgctcagacattatcaattatacagttatcaaagaaacatctaccgcattgaatctttttgaagatggacaattagatgtggctacactaagtggtgaactggcgcaacagaataaaaataatacgttgtatcattcgtatccaacagcgacaatgaactatttgcgcttaaatcaaaaacggnaagggcaagcnacgccgcttgcaaacgaaaacctgcgtaaagcattggctttaggaatagataaagaaaatctagtcaataatattattgcagatggttctaaagcgctacatggtgcgattacggaaggctttgtggcgaatcccacaacgggtctcgattttcgtcaagaagcaggtaatttaatggtttataacaaagaaaaagcgcaaagttattggaaaaaagcacaagcagaattaggagaaaaggttaacgttgaattgatggtaacagatgatggttcttacaaaaaaattggtgaaagtttgcaaggctcgctacaagaattgtttcctggtttgacaatagagctaaccgcattgccgactgaagctgcattgaactttgggcgagaaagtgactatgatttattcttaatttactggacaccagactatcaagaccctatttctaccctgatgactttatacaagggcaatgatcgcaattatcagaaccctgtctatgacaaattattagatgaagcagccacaacctatgccttagagccagaaaaaagatgggcgacactgattgcagctgaaaaagaagtgattgaaacgactgctggcatgattccacttagccaaaatgaacaaacagtcctgcaaaatgataaagtcaaaggcttgaattttcatacctttggcgctccattaacgttaaaaaatgtttataaggaaaaataa

SEQ ID NO: 82 - protein, 546 aa
MKKYLKITMVCILLVGFLAGCTNKNENKKKQKNTKEAVQLMSPSELTTLNTSVLLDFPDAIVQTAAFEGLYSLDEQDQLVPAVAKALPMISEDGKTYTISLRKEAVWSNDDPVTAHDFEYAWKKMIDPKNGFVYSFLIVETIQNGAEISAGKLAPNELGVTAVDDYTLKVTLKEPKPYFTSLLAFPTFFPQNXKVVEQFGADYGTASDKVVYNGPFVVKDWQQTKMDWQLAKNNRYWDHQNVRSDIINYTVIKETSTALNLFEDGQLDVATLSGELAQQNKNNTLYHSYPTATMNYLRLNQKRXGQATPLANENLRKALALGIDKENLVNNIIADGSKALHGAITEGFVANPTTGLDFRQEAGNLMVYNKEKAQSYWKKAQAELGEKVNVELMVTDDGSYKKIGESLQGSLQELFPGLTIELTALPTEAALNFGRESDYDLFLIYWTPDYQDPISTLMTLYKGNDRNYQNPVYDKLLDEAATTYALEPEKRWATLIAAEKEVIETTAGMIPLSQNEQTVLQNDKVKGLNFHTFGAPLTLKNVYKEK

SEQ ID NO: 83 - DNA, 1579 bp; double-stranded, linear
gtgtaccaataaaaatgaaaataaaaagaaacagaaaaataccaaagaagccgttcaactgatgtcaccctcggaattaacaacgctcaacacctctgtattattggattttccagatgctattgtccaaactgcagcgtttgaagggttatatagtttagatgaacaagaccaattggtaccagccgtagcaaaagcattgccgatgatttcagaagatggaaaaacctacacgatttctttgagaaaagaagcggtttggagtaacgatgatcctgtcacagcacatgattttgaatatgcttggaaaaaaatgattgatcctaaaaacggctttgtttatagcttcctcatcgttgaaacaattcaaaatggtgcagaaatctcagcggggaaattagcacccaatgaactaggtgtcacagctgtggatgattatacattaaaggtgacgctcaaagagccaaaaccgtactttacgtccttgttagcttttccgacatttttcccgcaaaatcnaaaagtagtcgaacaatttggtgcggactatggaactgctagtgataaagtcgtctataatggtccgttcgtggtaaaagattggcagcaaacaaagatggactggcaactagcaaaaaataatcgctattgggatcaccagaacgtgcgctcagacattatcaattatacagttatcaaagaaacatctaccgcattgaatctttttgaagatggacaattagatgtggctacactaagtggtgaactggcgcaacagaataaaaataatacgttgtatcattcgtatccaacagcgacaatgaactatttgcgcttaaatcaaaaacggnaagggcaagcnacgccgcttgcaaacgaaaacctgcgtaaagcattggctttaggaatagataaagaaaatctagtcaataatattattgcagatggttctaaagcgctacatggtgcgattacggaaggctttgtggcgaatcccacaacgggtctcgattttcgtcaagaagcaggtaatttaatggtttataacaaagaaaaagcgcaaagttattggaaaaaagcacaagcagaattaggagaaaaggttaacgttgaattgatggtaacagatgatggttcttacaaaaaaattggtgaaagtttgcaaggctcgctacaagaattgtttcctggtttgacaatagagctaaccgcattgccgactgaagctgcattgaactttgggcgagaaagtgactatgatttattcttaatttactggacaccagactatcaagaccctatttctaccctgatgactttatacaagggcaatgatcgcaattatcagaaccctgtctatgacaaattattagatgaagcagccacaacctatgccttagagccagaaaaaagatgggcgacactgattgcagctgaaaaagaagtgattgaaacgactgctggcatgattccacttagccaaaatgaacaaacagtcctgcaaaatgataaagtcaaaggcttgaattttcatacctttggcgctccattaacgttaaaaaatgtttataaggaaaaa

SEQ ID NO: 84 - protein, 526 aa
CTNKNENKKKQKNTKEAVQLMSPSELTTLNTSVLLDFPDAIVQTAAFEGLYSLDEQDQLVPAVAKALPMISEDGKTYTISLRKEAVWSNDDPVTAHDFEYAWKKMIDPKNGFVYSFLIVETIQNGAEISAGKLAPNELGVTAVDDYTLKVTLKEPKPYFTSLLAFPTFFPQNXKVVEQFGADYGTASDKVVYNGPFVVKDWQQTKMDWQLAKNNRYWDHQNVRSDIINYTVIKETSTALNLFEDGQLDVATLSGELAQQNKNNTLYHSYPTATMNYLRLNQKRXGQATPLANENLRKALALGIDKENLVNNIIADGSKALHGAITEGFVANPTTGLDFRQEAGNLMVYNKEKAQSYWKKAQAELGEKVNVELMVTDDGSYKKIGESLQGSLQELFPGLTIELTALPTEAALNFGRESDYDLFLIYWTPDYQDPISTLMTLYKGNDRNYQNPVYDKLLDEAATTYALEPEKRWATLIAAEKEVIETTAGMIPLSQNEQTVLQNDKVKGLNFHTFGAPLTLKNVYKEK

SEQ ID NO: 85 - DNA, 1680 bp; double-stranded, linear
taaaatggagggatcggtatgaagaaattaaaaatgttaggatgcgtcgggttgcttttagctttaacggcttgtcaggcgggaacgggaaactcggctgatagtaacaaagcagcggaacaaaaaattgcaattagttctgaagcggctatttcgacaatggaaccacacacagcgggggatacgacctcgactttagtcatgaatcaagtttatgaaggactctatgttttaggtaaagaagatgaattagagttgggggtcgctgccgaagaaccagcgatttctgaagatgaaaccgtttatacatttaagattagagaagatgccaaatggtcgaatgatgatccagtaacagcaaacgactttgtttatgcatggcaacaagttgcttcccctaaatcaggatcgattcatcaagctttattttttgatgtcattaaaaatgctaaggaaattgctttagaaggcgcagatgtgaatactcttggggttaaggcgctagatgataaaacgttagaaataactttagaacggcccaccccttatttgaaatcattactttcgtttcctgttttgtttccacaaaatgaaaaatatatcaaagaacaaggggataaatatgctactgatgcagaacatttgatttataatggtccttttaaattgaaagaatgggataatgcctcttctgatgactggacctacgaaaaaaatgatacgtattgggatgctgaaaaagttaaattaacagaagcgaaagtttcagtaattaagagcccaacgacagcggtgaatttgtttgactcgaatgaattggatgtagtgaataagctaagtggtgaatttattcctggttatgttgataatccagcctttctttcaattcctcaattcgtcacatactttttaaaaatgaacagcgttcgtgatggaaaagaaaatccggctttagcgaacaacaatattcgtaaagcgttggcacaagcttttgataaagaaagttttgtaaaagaagtcttgcaagatcaatcaacggctacagatcaagtaattccgccgggacaaacgattgcgccagatggaacagatttcacaaaactagctgctaagaaaaataactacttaacctacgatacagcgaaagcaaaagaattctgggaaaaagggaaaaaagaaattgggctggataaaatcaaattagaatttttaacagatgatacagacagcgccaaaaaagctgctgagtttttccaatttcaattggaagaaaatctagatggattagaagtgaatgttactcaagttccttttactattcgtgttgatcgtgatcaaacgagagactatgatttagaattatctggttggggaaccgattatcgtgatccattaacagttatgcgcatctttacttcggatagtaccttgggcggcgtaacgttcaagagtgatacgtatgatcaattaattcaagaaactagaacaacacatgcggctgatcaagaggctcgtttaaatgactttgctcaagcacaagatattttggtgaatcaggaaacggttttagcaccaatctacaatcgaagcatttctgtattagctaatcaaaaaatcaaggatctgtattggcattcatttggacccacgtacagtttaaaatgggcttatgttaactaa

SEQ ID NO: 86 - protein, 553 aa
MKKLKMLGCVGLLLALTACQAGTGNSADSNKAAEQKIAISSEAAISTMEPHTAGDTTSTLVMNQVYEGLYVLGKEDELELGVAAEEPAISEDETVYTFKIREDAKWSNDDPVTANDFVYAWQQVASPKSGSIHQALFFDVIKNAKEIALEGADVNTLGVKALDDKTLEITLERPTPYLKSLLSFPVLFPQNEKYIKEQGDKYATDAEHLIYNGPFKLKEWDNASSDDWTYEKNDTYWDAEKVKLTEAKVSVIKSPTTAVNLFDSNELDVVNKLSGEFIPGYVDNPAFLSIPQFVTYFLKMNSVRDGKENPALANNNIRKALAQAFDKESFVKEVLQDQSTATDQVIPPGQTIAPDGTDFTKLAAKKNNYLTYDTAKAKEFWEKGKKEIGLDKIKLEFLTDDTDSAKKAAEFFQFQLEENLDGLEVNVTQVPFTIRVDRDQTRDYDLELSGWGTDYRDPLTVMRIFTSDSTLGGVTFKSDTYDQLIQETRTTHAADQEARLNDFAQAQDILVNQETVLAPIYNRSISVLANQKIKDLYWHSFGPTYSLKWAYVN

SEQ ID NO: 87 - DNA, 1597 bp; double-stranded, linear
gggaacgggaaactcggctgatagtaacaaagcagcggaacaaaaaattgcaattagttctgaagcggctatttcgacaatggaaccacacacagcgggggatacgacctcgactttagtcatgaatcaagtttatgaaggactctatgttttaggtaaagaagatgaattagagttgggggtcgctgccgaagaaccagcgatttctgaagatgaaaccgtttatacatttaagattagagaagatgccaaatggtcgaatgatgatccagtaacagcaaacgactttgtttatgcatggcaacaagttgcttcccctaaatcaggatcgattcatcaagctttattttttgatgtcattaaaaatgctaaggaaattgctttagaaggcgcagatgtgaatactcttggggttaaggcgctagatgataaaacgttagaaataactttagaacggcccaccccttatttgaaatcattactttcgtttcctgttttgtttccacaaaatgaaaaatatatcaaagaacaaggggataaatatgctactgatgcagaacatttgatttataatggtccttttaaattgaaagaatgggataatgcctcttctgatgactggacctacgaaaaaaatgatacgtattgggatgctgaaaaagttaaattaacagaagcgaaagtttcagtaattaagagcccaacgacagcggtgaatttgtttgactcgaatgaattggatgtagtgaataagctaagtggtgaatttattcctggttatgttgataatccagcctttctttcaattcctcaattcgtcacatactttttaaaaatgaacagcgttcgtgatggaaaagaaaatccggctttagcgaacaacaatattcgtaaagcgttggcacaagcttttgataaagaaagttttgtaaaagaagtcttgcaagatcaatcaacggctacagatcaagtaattccgccgggacaaacgattgcgccagatggaacagatttcacaaaactagctgctaagaaaaataactacttaacctacgatacagcgaaagcaaaagaattctgggaaaaagggaaaaaagaaattgggctggataaaatcaaattagaatttttaacagatgatacagacagcgccaaaaaagctgctgagtttttccaatttcaattggaagaaaatctagatggattagaagtgaatgttactcaagttccttttactattcgtgttgatcgtgatcaaacgagagactatgatttagaattatctggttggggaaccgattatcgtgatccattaacagttatgcgcatctttacttcggatagtaccttgggcggcgtaacgttcaagagtgatacgtatgatcaattaattcaagaaactagaacaacacatgcggctgatcaagaggctcgtttaaatgactttgctcaagcacaagatattttggtgaatcaggaaacggttttagcaccaatctacaatcgaagcatttctgtattagctaatcaaaaaatcaaggatctgtattggcattcatttggacccacgtacagtttaaaatgggcttatgttaac

SEQ ID NO: 88 - protein, 532 aa
GTGNSADSNKAAEQKIAISSEAAISTMEPHTAGDTTSTLVMNQVYEGLYVLGKEDELELGVAAEEPAISEDETVYTFKIREDAKWSNDDPVTANDFVYAWQQVASPKSGSIHQALFFDVIKNAKEIALEGADVNTLGVKALDDKTLEITLERPTPYLKSLLSFPVLFPQNEKYIKEQGDKYATDAEHLIYNGPFKLKEWDNASSDDWTYEKNDTYWDAEKVKLTEAKVSVIKSPTTAVNLFDSNELDVVNKLSGEFIPGYVDNPAFLSIPQFVTYFLKMNSVRDGKENPALANNNIRKALAQAFDKESFVKEVLQDQSTATDQVIPPGQTIAPDGTDFTKLAAKKNNYLTYDTAKAKEFWEKGKKEIGLDKIKLEFLTDDTDSAKKAAEFFQFQLEENLDGLEVNVTQVPFTIRVDRDQTRDYDLELSGWGTDYRDPLTVMRIFTSDSTLGGVTFKSDTYDQLIQETRTTHAADQEARLNDFAQAQDILVNQETVLAPIYNRSISVLANQKIKDLYWHSFGPTYSLKWAYVN

SEQ ID NO: 89 - DNA, 429 bp; double-stranded, linear
taatggccgtttcgtctactaataaagaggatgaagctactcaaatggcgttggcaatggaacaaggatcataaaaaaggagaagtgagcatgaaaaaagtactaccttttattgccttagtcggcttgttattgttgtcaggttgtggaacagatatgaaaaagatattgactgccgatggtggtaaatggaaagtggaagaaacacgtgcaacttacactttttttgatgacggtaaattttcagctaatgactcagaggatagtgttagtgggacatacacttatgatgaaaaaaataaaaaaataacctttgacnttactagcagnaactctttcattatggaaaaagtngantncaangntancaagattacaggggaaattggcgaaaaacaaagaacacttataaaacaaaaaacagaataa

SEQ ID NO: 90 - protein, 112 aa
MKKVLPFIALVGLLLLSGCGTDMKKILTADGGKWKVEETRATYTFFDDGKFSANDSEDSVSGTYTYDEKNKKITFDXTSXNSFIMEKVXXXXXKITGEIGEKQRTLIKQKTE

SEQ ID NO: 91 - DNA, 259 bp; double-stranded, linear
attgactgccgatggtggtaaatggaaagtggaagaaacacgtgcaacttacactttttttgatgacggtaaattttcagctaatgactcagaggatagtgttagtgggacatacacttatgatgaaaaaaataaaaaaataacctttgacnttactagcagnaactctttcattatggaaaaagtngantncaangntancaagattacaggggaaattggcgaaaaacaaagaacacttataaaacaaaaaacagaa

SEQ ID NO: 92 - protein, 86 aa
LTADGGKWKVEETRATYTFFDDGKFSANDSEDSVSGTYTYDEKNKKITFDXTSXNSFIMEKVXXXXXKITGEIGEKQRTLIKQKTE

SEQ ID NO: 93 - DNA, 951 bp; double-stranded, linear
tgaatgaaacatattaaaggaatgttggtttttatcggattatttattttggttggttgtgcgccagatcaagagccaacgaaacaaacaacaagtggtccgcaagagacaaagcaagtgaagcaagttaccgtcaccaatcaaacgacttctgcggtggaaaaacaagcgccgactaaaaatgacgaactgattgctaatcaattgacttttgattctcatgaatacacgtacgaagtggttacaggggccacacaaacgacatttggaacaaccccaccagcaaaatatacaccggaagaaaaaaagaaaaaaatgttttggtccaatcaaccgcctttgggattaatgacgggtaactattataaaaatgaaggtgtatttactggcggaaattacggcattgtagagattattacggaacctgaaacgcaaaggattctgaatgttgagtttacagagtttgctagtgatccttattatgatacacgctattcgggtgtcaacaaacgcctgtcggattatcctgaatttcaagcaagcaacacgcgtacagacgatacgttagtcaccgttgttaatggtattacttatgtagaaaaacaaatgcgtgacgaaaatcgtgttacaggtaatttttatacggtacgcggttcatcaacttctgcgcgtgaaggattaatgcctttagcagcagagatggacacttggctaaaagagccatcgaaagaaacgtatatcggttacgcagaagatttaggcaatggcctaatcgctcgacttcaagtgataacagaagagcagaaaataaaacatgtcagctatgatgaatacttttcagatgaacaggaaaaaatcacagaaacagcctgcggcctttttatcgtcaatcgaaatattattcaccaggatacaataaacaaaccaacaattcttttattcattttgtag

SEQ ID NO: 94 - protein, 315 aa
MKHIKGMLVFIGLFILVGCAPDQEPTKQTTSGPQETKQVKQVTVTNQTTSAVEKQAPTKNDELIANQLTFDSHEYTYEVVTGATQTTFGTTPPAKYTPEEKKKKMFWSNQPPLGLMTGNYYKNEGVFTGGNYGIVEIITEPETQRILNVEFTEFASDPYYDTRYSGVNKRLSDYPEFQASNTRTDDTLVTVVNGITYVEKQMRDENRVTGNFYTVRGSSTSAREGLMPLAAEMDTWLKEPSKETYIGYAEDLGNGLIARLQVITEEQKIKHVSYDEYFSDEQEKITETACGLFIVNRNIIHQDTINKPTILLFIL

SEQ ID NO: 95 - DNA, 871 bp; double-stranded, linear
aacgaaacaaacaacaagtggtccgcaagagacaaagcaagtgaagcaagttaccgtcaccaatcaaacgacttctgcggtggaaaaacaagcgccgactaaaaatgacgaactgattgctaatcaattgacttttgattctcatgaatacacgtacgaagtggttacaggggccacacaaacgacatttggaacaaccccaccagcaaaatatacaccggaagaaaaaaagaaaaaaatgttttggtccaatcaaccgcctttgggattaatgacgggtaactattataaaaatgaaggtgtatttactggcggaaattacggcattgtagagattattacggaacctgaaacgcaaaggattctgaatgttgagtttacagagtttgctagtgatccttattatgatacacgctattcgggtgtcaacaaacgcctgtcggattatcctgaatttcaagcaagcaacacgcgtacagacgatacgttagtcaccgttgttaatggtattacttatgtagaaaaacaaatgcgtgacgaaaatcgtgttacaggtaatttttatacggtacgcggttcatcaacttctgcgcgtgaaggattaatgcctttagcagcagagatggacacttggctaaaagagccatcgaaagaaacgtatatcggttacgcagaagatttaggcaatggcctaatcgctcgacttcaagtgataacagaagagcagaaaataaaacatgtcagctatgatgaatacttttcagatgaacaggaaaaaatcacagaaacagcctgcggcctttttatcgtcaatcgaaatattattcaccaggatacaataaacaaaccaacaattcttttattcattttg

SEQ ID NO: 96 - protein, 290 aa
TKQTTSGPQETKQVKQVTVTNQTTSAVEKQAPTKNDELIANQLTFDSHEYTYEVVTGATQTTFGTTPPAKYTPEEKKKKMFWSNQPPLGLMTGNYYKNEGVFTGGNYGIVEIITEPETQRILNVEFTEFASDPYYDTRYSGVNKRLSDYPEFQASNTRTDDTLVTVVNGITYVEKQMRDENRVTGNFYTVRGSSTSAREGLMPLAAEMDTWLKEPSKETYIGYAEDLGNGLIARLQVITEEQKIKHVSYDEYFSDEQEKITETACGLFIVNRNIIHQDTINKPTILLFIL

SEQ ID NO: 97 - DNA, 648 bp; double-stranded, linear
tgagtgtatgattactcatttccctttgaatcagttatgataaaggaagaaataaataaattttttggagggattttcatgaaaatgtctaaagtactcaccactgttttgacggcaactgctgctcttgtgttgcttagtgcttgttcatctgataaaaaaacagatagtagttctagtagcaaagaaacagctaattcaagtacagaagtagtctctggtgcttcaattagtgccaagcctgaagagctcgaaatggcgttaagtgataaaggaaattggattgtcgcagctactgacaatgtcacttttgataaagaggtaacagttgctggtactttccatgataaggggaaagattccaacgatgtctatcgtaaattagcactttattcccaagatgataataaaaaagtaactgctgaatatgaaatcacggttcctaagctaatcgtttcttctgaaaatttcaacatcgttcacgggactgtcaaaggtgatattgaggtgaaagcaaatggctttactttaaatggtaccaaagttaatggcaatattacttttgataaacaagaatacaaagattctgctgacttagaaaaagatggtgccactgttactggtgaagtcaccgtagccaataattaa

SEQ ID NO: 98 - protein, 189 aa
MKMSKVLTTVLTATAALVLLSACSSDKKTDSSSSSKETANSSTEVVSGASISAKPEELEMALSDKGNWIVAATDNVTFDKEVTVAGTFHDKGKDSNDVYRKLALYSQDDNKKVTAEYEITVPKLIVSSENFNIVHGTVKGDIEVKANGFTLNGTKVNGNITFDKQEYKDSADLEKDGATVTGEVTVANN

SEQ ID NO: 99 - DNA, 484 bp; double-stranded, linear
aacagatagtagttctagtagcaaagaaacagctaattcaagtacagaagtagtctctggtgcttcaattagtgccaagcctgaagagctcgaaatggcgttaagtgataaaggaaattggattgtcgcagctactgacaatgtcacttttgataaagaggtaacagttgctggtactttccatgataaggggaaagattccaacgatgtctatcgtaaattagcactttattcccaagatgataataaaaaagtaactgctgaatatgaaatcacggttcctaagctaatcgtttcttctgaaaatttcaacatcgttcacgggactgtcaaaggtgatattgaggtgaaagcaaatggctttactttaaatggtaccaaagttaatggcaatattacttttgataaacaagaatacaaagattctgctgacttagaaaaagatggtgccactgttactggtgaagtcaccgtagccaataat

SEQ ID NO: 100 - protein, 161 aa
TDSSSSSKETANSSTEVVSGASISAKPEELEMALSDKGNWIVAATDNVTFDKEVTVAGTFHDKGKDSNDVYRKLALYSQDDNKKVTAEYEITVPKLIVSSENFNIVHGTVKGDIEVKANGFTLNGTKVNGNITFDKQEYKDSADLEKDGATVTGEVTVANN

SEQ ID NO: 101 - DNA, 1122 bp; double-stranded, linear
tttggtatgaaacagaaaaagtggttaatcggacttgttgcactgggcttggttttagcagcatgtggaagtggcggttcgaaaacgacctcaaacgaaccagctacacagaaaattaacgtcgcatctggtggtgaactctcgacattagacagcgctcattatacagatgtctatagttccgatatgattggtcaagtagttgaaggcttgtatcgacaagataaaaacggagatcctgagctagctatggcgaaagcagagccacaagttagtgaagacgggttagtctatacattcaagttacgagaagcaaaatggacaaacggggatccagttaaagcaggggattttgtagttgcgtttagaaacgtggtcgatccagcatacggttcaagtagcagtaatcaaatggatatttttaaaaatgggcgtgcggtgcgggaaggacaagccacgatggaagaatttggtgtcaaagcaatcgatgaccagacactagaactaacattggaaaatccaattccttatttagcccaagtcttggttgggacaccttttatgcctaaaaatgaagcctttgccaaagaaaaaggtactgcctatgggacttctgcagataattttgttggcaatgggccgtttgtaatttcaggttgggatggcaattccgaaacttggaaattgaagaagaatgatcattattgggataaagaacacgtaaaattgaatgaaattgatgttcaagtagtgaaagaaattggcacaggagccaatctttttgataatggcgacttagattacactgttttagcagatacttatgcacttcagtataaagagtcaaaacaagcgcattttgtacctaaagccatggtgggttatttaagccccaatcatcgccgtgaaattaccggcaacgaacatgttcgaaaagcttttttacaagcgattgacaaagaaacttttgcaaaagaaattttaggagatggctcgacagctttaaatggntttgtaccagctaattttgcaaaaatccagatacaggtgaagatttccgcaaagaaaatggtgatttattgccatataatattaaagaagcccaagctaactggaacaatt

SEQ ID NO: 102 - protein, 372 aa
MKQKKWLIGLVALGLVLAACGSGGSKTTSNEPATQKINVASGGELSTLDSAHYTDVYSSDMIGQVVEGLYRQDKNGDPELAMAKAEPQVSEDGLVYTFKLREAKWTNGDPVKAGDFVVAFRNVVDPAYGSSSSNQMDIFKNGRAVREGQATMEEFGVKAIDDQTLELTLENPIPYLAQVLVGTPFMPKNEAFAKEKGTAYGTSADNFVGNGPFVISGWDGNSETWKLKKNDHYWDKEHVKLNEIDVQVVKEIGTGANLFDNGDLDYTVLADTYALQYKESKQAHFVPKAMVGYLSPNHRREITGNEHVRKAFLQAIDKETFAKEILGDGSTALNGFVPANFAKIQIQVKISAKKMVIYCHIILKKPKLTGTI

SEQ ID NO: 103 - DNA, 1028 bp; double-stranded, linear
aacgacctcaaacgaaccagctacacagaaaattaacgtcgcatctggtggtgaactctcgacattagacagcgctcattatacagatgtctatagttccgatatgattggtcaagtagttgaaggcttgtatcgacaagataaaaacggagatcctgagctagctatggcgaaagcagagccacaagttagtgaagacgggttagtctatacattcaagttacgagaagcaaaatggacaaacggggatccagttaaagcaggggattttgtagttgcgtttagaaacgtggtcgatccagcatacggttcaagtagcagtaatcaaatggatatttttaaaaatgggcgtgcggtgcgggaaggacaagccacgatggaagaatttggtgtcaaagcaatcgatgaccagacactagaactaacattggaaaatccaattccttatttagcccaagtcttggttgggacaccttttatgcctaaaaatgaagcctttgccaaagaaaaaggtactgcctatgggacttctgcagataattttgttggcaatgggccgtttgtaatttcaggttgggatggcaattccgaaacttggaaattgaagaagaatgatcattattgggataaagaacacgtaaaattgaatgaaattgatgttcaagtagtgaaagaaattggcacaggagccaatctttttgataatggcgacttagattacactgttttagcagatacttatgcacttcagtataaagagtcaaaacaagcgcattttgtacctaaagccatggtgggttatttaagccccaatcatcgccgtgaaattaccggcaacgaacatgttcgaaaagcttttttacaagcgattgacaaagaaacttttgcaaaagaaattttaggagatggctcgacagctttaaatggntttgtaccagctaattttgcaaaaatccagatacaggtgaagatttccgcaaagaaaatggtgatttattgccatataatattaaagaagcccaagctaa

SEQ ID NO: 104 - protein, 342 aa
TTSNEPATQKINVASGGELSTLDSAHYTDVYSSDMIGQVVEGLYRQDKNGDPELAMAKAEPQVSEDGLVYTFKLREAKWTNGDPVKAGDFVVAFRNVVDPAYGSSSSNQMDIFKNGRAVREGQATMEEFGVKAIDDQTLELTLENPIPYLAQVLVGTPFMPKNEAFAKEKGTAYGTSADNFVGNGPFVISGWDGNSETWKLKKNDHYWDKEHVKLNEIDVQVVKEIGTGANLFDNGDLDYTVLADTYALQYKESKQAHFVPKAMVGYLSPNHRREITGNEHVRKAFLQAIDKETFAKEILGDGSTALNGFVPANFAKIQIQVKISAKKMVIYCHIILKKPKL

SEQ ID NO: 105 - DNA, 1116 bp; double-stranded, linear
taacagaagcaatacaacaacttaacactttgtttacttgttatttatcagaaatcaactaagacttgttatagtcaatgtatgggtagatatgaaggaggaaacaaggaaatgaagaaaagagctttgctaggggttaccttattaacattcacaacattagcgggttgtacaaatttatctgaacagaaaagcggcgaaaaacaaacagaggttgctgaagcgaaggcaactgaatctgaaaaagcatcagtaaaaaatgttatttttatgattggagatggcatggggaatccgtatacaacgggctatcgctatttcaaagccaatcactcagacaagcgtgttccccaaacagcttttgatacctatttggtcggacagcaagccacttatccagaagatgaagaagagaatgtcaccgattcagcttccgcagcgacagcgatggctgccggagtgaaaacctataataatgctattgcactcgataatgacaagtccaaaacagaaacagtgctcgaacgtgcgaaaaaagtggggaaatcaacgggtcttgtagcaacatctgaaataacacatgcaacccctgctgcatatggcgcacataatgtttcacgcaaaaatatggcagaaatcgccgatgactattttgatgatcaaatcgacggacaacacaaagtcgatgtgttacttggcggcggctccgaattatttgcccggaaagatcgtgatttagtcaaagaattttcccaagcgggttatggtcatgtcacagacaaaaagtcgttaaatgagaaccaagacgacaaaattttaggcttgtttgcaccaggcgggctacctaaaatgattgaccgaacggaagaagtcccttcattagctgatatgacagaagcggctcttcaacggttagataaaaatgaaaaaggtttctttttaatggttgaaggtagtcaaattgattgggccgggcatagcaatgatattgttggcgcgatgagcgaaatgcaagacttcgaagcggcgtttgaaaaggccatcgattttgccaaaaaagatggtgaacattggtggttacaactgcagatcattcaacagggggcttgtctttag

SEQ ID NO: 106 - protein, 334 aa
MKKRALLGVTLLTFTTLAGCTNLSEQKSGEKQTEVAEAKATESEKASVKNVIFMIGDGMGNPYTTGYRYFKANHSDKRVPQTAFDTYLVGQQATYPEDEEENVTDSASAATAMAAGVKTYNNAIALDNDKSKTETVLERAKKVGKSTGLVATSEITHATPAAYGAHNVSRKNMAEIADDYFDDQIDGQHKVDVLLGGGSELFARKDRDLVKEFSQAGYGHVTDKKSLNENQDDKILGLFAPGGLPKMIDRTEEVPSLADMTEAALQRLDKNEKGFFLMVEGSQIDWAGHSNDIVGAMSEMQDFEAAFEKAIDFAKKDGEHWWLQLQIIQQGACL

SEQ ID NO: 107 - DNA, 928 bp; double-stranded, linear
acagaaaagcggcgaaaaacaaacagaggttgctgaagcgaaggcaactgaatctgaaaaagcatcagtaaaaaatgttatttttatgattggagatggcatggggaatccgtatacaacgggctatcgctatttcaaagccaatcactcagacaagcgtgttccccaaacagcttttgatacctatttggtcggacagcaagccacttatccagaagatgaagaagagaatgtcaccgattcagcttccgcagcgacagcgatggctgccggagtgaaaacctataataatgctattgcactcgataatgacaagtccaaaacagaaacagtgctcgaacgtgcgaaaaaagtggggaaatcaacgggtcttgtagcaacatctgaaataacacatgcaacccctgctgcatatggcgcacataatgtttcacgcaaaaatatggcagaaatcgccgatgactattttgatgatcaaatcgacggacaacacaaagtcgatgtgttacttggcggcggctccgaattatttgcccggaaagatcgtgatttagtcaaagaattttcccaagcgggttatggtcatgtcacagacaaaaagtcgttaaatgagaaccaagacgacaaaattttaggcttgtttgcaccaggcgggctacctaaaatgattgaccgaacggaagaagtcccttcattagctgatatgacagaagcggctcttcaacggttagataaaaatgaaaaaggtttctttttaatggttgaaggtagtcaaattgattgggccgggcatagcaatgatattgttggcgcgatgagcgaaatgcaagacttcgaagcggcgtttgaaaaggccatcgattttgccaaaaaagatggtgaacattggtggttacaactgcagatcattcaacagggggcttgtctt

SEQ ID NO: 108 - protein, 309 aa
QKSGEKQTEVAEAKATESEKASVKNVIFMIGDGMGNPYTTGYRYFKANHSDKRVPQTAFDTYLVGQQATYPEDEEENVTDSASAATAMAAGVKTYNNAIALDNDKSKTETVLERAKKVGKSTGLVATSEITHATPAAYGAHNVSRKNMAEIADDYFDDQIDGQHKVDVLLGGGSELFARKDRDLVKEFSQAGYGHVTDKKSLNENQDDKILGLFAPGGLPKMIDRTEEVPSLADMTEAALQRLDKNEKGFFLMVEGSQIDWAGHSNDIVGAMSEMQDFEAAFEKAIDFAKKDGEHWWLQLQIIQQGACL

SEQ ID NO: 109 - DNA, 600 bp; double-stranded, linear
tgaaggagggagaaaatgaaaaagttaatcggtaaaaagtggctgctgcttacagcagtagccacttttttattatcaggatgcgcaagtcttgaacaaaaagcacaggatagtgtaaaagaagttactgaaaatgttactcaaactatttcaaacgatcaacgtataccagctgattttgttaggcacgtggatggcgataccacagtattaaaaattgacggaaaagaacaaaaagttcggtttttattaattgacacacccgagactgtgaaaccgaaaacaaaagttcagccgttcggattggaagctagcaaacgcacaaaagagcttttgtctactgcttcagaaattacgtttgaatatgataagggcgataaaacagatcgttacggacgagcgttgggctacatattcgtagatggaacattactacaaaaaacgcttgtaagtgaaggattagctcgtgttgcctatgtaaaagagcctacaactaagtatttggcagaactagagcaagcccaagaacaggctaaaaatgagtcactcggaatctggagcataccaggttatgtgacacaacgggggtttagtaaataa

SEQ ID NO: 110 - protein, 194 aa
MKKLIGKKWLLLTAVATFLLSGCASLEQKAQDSVKEVTENVTQTISNDQRIPADFVRHVDGDTTVLKIDGKEQKVRFLLIDTPETVKPKTKVQPFGLEASKRTKELLSTASEITFEYDKGDKTDRYGRALGYIFVDGTLLQKTLVSEGLARVAYVKEPTTKYLAELEQAQEQAKNESLGIWSIPGYVTQRGFSK

SEQ ID NO: 111 - DNA, 466 bp; double-stranded, linear
aaatgttactcaaactatttcaaacgatcaacgtataccagctgattttgttaggcacgtggatggcgataccacagtattaaaaattgacggaaaagaacaaaaagttcggtttttattaattgacacacccgagactgtgaaaccgaaaacaaaagttcagccgttcggattggaagctagcaaacgcacaaaagagcttttgtctactgcttcagaaattacgtttgaatatgataagggcgataaaacagatcgttacggacgagcgttgggctacatattcgtagatggaacattactacaaaaaacgcttgtaagtgaaggattagctcgtgttgcctatgtaaaagagcctacaactaagtatttggcagaactagagcaagcccaagaacaggctaaaaatgagtcactcggaatctggagcataccaggttatgtgacacaacgggggtttagtaaa

SEQ ID NO: 112 - protein, 155 aa
NVTQTISNDQRIPADFVRHVDGDTTVLKIDGKEQKVRFLLIDTPETVKPKTKVQPFGLEASKRTKELLSTASEITFEYDKGDKTDRYGRALGYIFVDGTLLQKTLVSEGLARVAYVKEPTTKYLAELEQAQEQAKNESLGIWSIPGYVTQRGFSK

SEQ ID NO: 113 - DNA, 1242 bp; double-stranded, linear
tgattgacacatagggggaatagtatgaaaaagttaaaaatgatggggattatgttatttgttagtacggtcttggtaggttgtggcacaacagcaganacaaaaatagacgagaaagcaactgagaaaaccagtgtctcgaaaaaagttttaaatttaatggagaactcggaaatcggttcaatggattctatttttacacaagatgaagccagtattaacgcacagtccaatgtctttgaagggttatatcaattggatgaaaaagatcaactaatacctgctgctgctaaagagatgccagaaatttctgaggatggcaaacgatataccattaaactaagagaagatggcaagtggtccaatggtgatgctgtaacagccaatgatttcgtttttgcttggcgtaaattagcgaatcccaaaaaccaagccaattactttttcttgttagaaggaacgattctgaacggaacagctattacaaaagaggaaaaagcaccagaggaattgggtgtcaaagcgcttgatgattatactttggaggttactttagaaaagcctgtaccatattttacgtcgttattggcattttctccatttttcccacaaaacgaagcattcgtgaaagaaaaaggacaagcctatggcacttctagtgaaatgattgtatctaatggtccgtttttaatgaaaaattgggatcagtcagcgatgtcgtgggattttgtgcgtaatccctactattacgataaagaaaaagtaaaatcagaaacgattcattttgaagttcttaaagaaaccaataccgtttataatttgtacgaatcaggtgaattagatgtggctgtcttaacaggagattttgctaaacaaaatcgagacaacccagactatgaagcaatcgaacggtcaaaagtctattccttacgtttaaaccaaaaaagaaacgaaaaaccatccatttttgcaaatgagaatgtccgcaaagctttagcttatgctttggataaaaaaagtttagtcgataatattttagcagatggctcaaaagaaatttatgggtacattccagaaaaatttgtatataacccagaaacgaatgaagattttcgtcaagaagcaggcgctcttgtcaaaacagacgccaaaaaagccaaagagtatttagataaagcaaaagcagagctaaacggagatgtagccattgaacttctttcaagagatggtgatagtgaccga

SEQ ID NO: 114 - protein, 406 aa
MKKLKMMGIMLFVSTVLVGCGTTAXTKIDEKATEKTSVSKKVLNLMENSEIGSMDSIFTQDEASINAQSNVFEGLYQLDEKDQLIPAAAKEMPEISEDGKRYTIKLREDGKWSNGDAVTANDFVFAWRKLANPKNQANYFFLLEGTILNGTAITKEEKAPEELGVKALDDYTLEVTLEKPVPYFTSLLAFSPFFPQNEAFVKEKGQAYGTSSEMIVSNGPFLMKNWDQSAMSWDFVRNPYYYDKEKVKSETIHFEVLKETNTVYNLYESGELDVAVLTGDFAKQNRDNPDYEAIERSKVYSLRLNQKRNEKPSIFANENVRKALAYALDKKSLVDNILADGSKEIYGYIPEKFVYNPETNEDFRQEAGALVKTDAKKAKEYLDKAKAELNGDVAIELLSRDGDSDR

SEQ ID NO: 115 - DNA, 1119 bp; double-stranded, linear
gagaaagcaactgagaaaaccagtgtctcgaaaaaagttttaaatttaatggagaactcggaaatcggttcaatggattctatttttacacaagatgaagccagtattaacgcacagtccaatgtctttgaagggttatatcaattggatgaaaaagatcaactaatacctgctgctgctaaagagatgccagaaatttctgaggatggcaaacgatataccattaaactaagagaagatggcaagtggtccaatggtgatgctgtaacagccaatgatttcgtttttgcttggcgtaaattagcgaatcccaaaaaccaagccaattactttttcttgttagaaggaacgattctgaacggaacagctattacaaaagaggaaaaagcaccagaggaattgggtgtcaaagcgcttgatgattatactttggaggttactttagaaaagcctgtaccatattttacgtcgttattggcattttctccatttttcccacaaaacgaagcattcgtgaaagaaaaaggacaagcctatggcacttctagtgaaatgattgtatctaatggtccgtttttaatgaaaaattgggatcagtcagcgatgtcgtgggattttgtgcgtaatccctactattacgataaagaaaaagtaaaatcagaaacgattcattttgaagttcttaaagaaaccaataccgtttataatttgtacgaatcaggtgaattagatgtggctgtcttaacaggagattttgctaaacaaaatcgagacaacccagactatgaagcaatcgaacggtcaaaagtctattccttacgtttaaaccaaaaaagaaacgaaaaaccatccatttttgcaaatgagaatgtccgcaaagctttagcttatgctttggataaaaaaagtttagtcgataatattttagcagatggctcaaaagaaatttatgggtacattccagaaaaatttgtatataacccagaaacgaatgaagattttcgtcaagaagcaggcgctcttgtcaaaacagacgccaaaaaagccaaagagtatttagataaagcaaaagcagagctaaacggagatgtagccattgaacttctttcaagagatggt

SEQ ID NO: 116 - protein, 373 aa
EKATEKTSVSKKVLNLMENSEIGSMDSIFTQDEASINAQSNVFEGLYQLDEKDQLIPAAAKEMPEISEDGKRYTIKLREDGKWSNGDAVTANDFVFAWRKLANPKNQANYFFLLEGTILNGTAITKEEKAPEELGVKALDDYTLEVTLEKPVPYFTSLLAFSPFFPQNEAFVKEKGQAYGTSSEMIVSNGPFLMKNWDQSAMSWDFVRNPYYYDKEKVKSETIHFEVLKETNTVYNLYESGELDVAVLTGDFAKQNRDNPDYEAIERSKVYSLRLNQKRNEKPSIFANENVRKALAYALDKKSLVDNILADGSKEIYGYIPEKFVYNPETNEDFRQEAGALVKTDAKKAKEYLDKAKAELNGDVAIELLSRDG

SEQ ID NO: 117 - DNA, 813 bp; double-stranded, linear
tgagaaattagttattttagaaaaataaaaaccattttggaggaagatttaaaaatgaaaaaacgcgtaattttagggacattagtcgctgcaacgttattaatgactgcttgtggaaacagcgaagcaactacgaaaagcgagagcaaaggtggaagtaatgctttagtcgtttcaactttcggattaagtgaagatattgtcaaaaaagacattatcgctccatttgaaaaagagaatgaagcgaaagttaccttagaagtaggcaatagcgcagaccgctttacgaaattaaaaaataatcccaatgcgggaattgatgtcattgaattagcacaagcaaatgcagcacaaggtggaaaagatgggttatttgaaaaaattacagaaaaagaagtacctaatttaagtcagttaacgccgggagcaaaagaggtttttgaaagtggtgctggcgtaccaatcgctgtaaacagtatcgggattgtttacaacaaagaaaaattaggcaaagaaattaaaaactgggatgacttatggtcagctgatttgaaaggtaaaatttctgttccagacgttgccacgacggcaggtcctttaatgttatacgttgctagtgaacatgctggtcaagatattacaaaagataacgggaaggccgcttttgaagcgatgaaagaattaaaaccaaacgttgttaaaacgtattcaaaatcgtcagacttagcnaatatgttccaatctggtgaaattgaagcagctgtggttgctgattttgcggttgatattattcaaggcgcacagaaaacgtga

SEQ ID NO: 118 - protein, 252 aa
MKKRVILGTLVAATLLMTACGNSEATTKSESKGGSNALVVSTFGLSEDIVKKDIIAPFEKENEAKVTLEVGNSADRFTKLKNNPNAGIDVIELAQANAAQGGKDGLFEKITEKEVPNLSQLTPGAKEVFESGAGVPIAVNSIGIVYNKEKLGKEIKNWDDLWSADLKGKISVPDVATTAGPLMLYVASEHAGQDITKDNGKAAFEAMKELKPNVVKTYSKSSDLANMFQSGEIEAAVVADFAVDIIQGAQKT

SEQ ID NO: 119 - DNA, 680 bp; double-stranded, linear
aactacgaaaagcgagagcaaaggtggaagtaatgctttagtcgtttcaactttcggattaagtgaagatattgtcaaaaaagacattatcgctccatttgaaaaagagaatgaagcgaaagttaccttagaagtaggcaatagcgcagaccgctttacgaaattaaaaaataatcccaatgcgggaattgatgtcattgaattagcacaagcaaatgcagcacaaggtggaaaagatgggttatttgaaaaaattacagaaaaagaagtacctaatttaagtcagttaacgccgggagcaaaagaggtttttgaaagtggtgctggcgtaccaatcgctgtaaacagtatcgggattgtttacaacaaagaaaaattaggcaaagaaattaaaaactgggatgacttatggtcagctgatttgaaaggtaaaatttctgttccagacgttgccacgacggcaggtcctttaatgttatacgttgctagtgaacatgctggtcaagatattacaaaagataacgggaaggccgcttttgaagcgatgaaagaattaaaaccaaacgttgttaaaacgtattcaaaatcgtcagacttagcnaatatgttccaatctggtgaaattgaagcagctgtggttgctgattttgcggttgatattattcaaggcgcacagaaaa

SEQ ID NO: 120 - protein, 226 aa
TTKSESKGGSNALVVSTFGLSEDIVKKDIIAPFEKENEAKVTLEVGNSADRFTKLKNNPNAGIDVIELAQANAAQGGKDGLFEKITEKEVPNLSQLTPGAKEVFESGAGVPIAVNSIGIVYNKEKLGKEIKNWDDLWSADLKGKISVPDVATTAGPLMLYVASEHAGQDITKDNGKAAFEAMKELKPNVVKTYSKSSDLANMFQSGEIEAAVVADFAVDIIQGAQK

SEQ ID NO: 121 - DNA, 765 bp; double-stranded, linear
tgaataaattatttaggaggaattatgatgaaaaaattaattagtttaggattggtttgtgtttgtggtatttcactacttactgcttgtncgggaaataatgataataaagatactgaaaagtcaaccagtcaatctagcagcacagttaaacaaccgaattcaaaagactttgttgcgtcaggggaatattcagttggaaaagatattgatcctggagattactatgctgtattaactcaactagatgataaatcgagcatagttcttattaccgtcaaatcaggcggagaaaatagtaaccatgacttatacggagtgggaaacaagaaaaaagtatctcttaaaaagggagatactctcacattcgaaactgccgacaaagattttgttgttagatttttaaatgaaaaagattttcaagaatatatgaaaaatccagtatcnagtactgaaactagcaaacanaaaacagtaaactctgatgtttctaaaagtagtagccaagataataaacaatctgatgtatctgaaaaaaaagaagtaagtactgaagcgaagtctgatgtagctactaatactttaccgagcgaagataaaaatactaatgacattactaagctagcagatgagccaaccttagaacaacaaaccgtcttagatactttagctaagcatcaatttaatgatatgtatccttataaaggaagcaaaatgcattcaattatcggcgtcatcccaaccatggacgcaaaaagatggtaa

SEQ ID NO: 122 - protein, 245 aa
MKKLISLGLVCVCGISLLTACXGNNDNKDTEKSTSQSSSTVKQPNSKDFVASGEYSVGKDIDPGDYYAVLTQLDDKSSIVLITVKSGGENSNHDLYGVGNKKKVSLKKGDTLTFETADKDFVVRFLNEKDFQEYMKNPVSSTETSKXKTVNSDVSKSSSQDNKQSDVSEKKEVSTEAKSDVATNTLPSEDKNTNDITKLADEPTLEQQTVLDTLAKHQFNDMYPYKGSKMHSIIGVIPTMDAKRW

SEQ ID NO: 123 - DNA, 664 bp; double-stranded, linear
taatgataataaagatactgaaaagtcaaccagtcaatctagcagcacagttaaacaaccgaattcaaaagactttgttgcgtcaggggaatattcagttggaaaagatattgatcctggagattactatgctgtattaactcaactagatgataaatcgagcatagttcttattaccgtcaaatcaggcggagaaaatagtaaccatgacttatacggagtgggaaacaagaaaaaagtatctcttaaaaagggagatactctcacattcgaaactgccgacaaagattttgttgttagatttttaaatgaaaaagattttcaagaatatatgaaaaatccagtatcnagtactgaaactagcaaacanaaaacagtaaactctgatgtttctaaaagtagtagccaagataataaacaatctgatgtatctgaaaaaaaagaagtaagtactgaagcgaagtctgatgtagctactaatactttaccgagcgaagataaaaatactaatgacattactaagctagcagatgagccaaccttagaacaacaaaccgtcttagatactttagctaagcatcaatttaatgatatgtatccttataaaggaagcaaaatgcattcaattatcggcgtcatcccaaccatggacgcaaaaagatgg

SEQ ID NO: 124 - protein, 221 aa
NDNKDTEKSTSQSSSTVKQPNSKDFVASGEYSVGKDIDPGDYYAVLTQLDDKSSIVLITVKSGGENSNHDLYGVGNKKKVSLKKGDTLTFETADKDFVVRFLNEKDFQEYMKNPVSSTETSKXKTVNSDVSKSSSQDNKQSDVSEKKEVSTEAKSDVATNTLPSEDKNTNDITKLADEPTLEQQTVLDTLAKHQFNDMYPYKGSKMHSIIGVIPTMDAKRW

SEQ ID NO: 125 - DNA, 675 bp; double-stranded, linear
tgactgctttttttctattggagaaaaaagtggtttttttgtattgttttgacgttgagacaaaggaggttcatttcagaaaattttccccaaaataaaatagacgaatgcgaggatgaaaaaatgaaaaaatttactttaacaatgatgactttaggtttagtagcaacacttggcttagcaggatgtggtaaacaggaaaagaaagcaactacctcttctgaaaaaacagaagtaacgttaccaaccaaagaccgtagcggcaaagaaattactttacccaaagaagcaaccaaaattatttccctagtgccatcaacaacagaagtgattgaagacttaggtaaaaccgaccaattaatcgcagttgatactcaaagtagtacaatgatgactgatttaaaaaaattaccacaaatggatatgatggctgtcgatgccgaaaaattgattgccttgaaaccacaaattgtttatgtgaatgacatcaatttagctagctcagaaagtgtttggaagcaagtggaagatgctggaattacagtcgttaatatccccactagtacaagcatcaaagcaatcaaagaagacgtccaattcatcgctgatagcttatctgaacatgaaaaaggacaaaagttaatcaaaacaatggatcaagaaatcgacgagtag

SEQ ID NO: 126 - protein, 183 aa
MKKFTLTMMTLGLVATLGLAGCGKQEKKATTSSEKTEVTLPTKDRSGKEITLPKEATKIISLVPSTTEVIEDLGKTDQLIAVDTQSSTMMTDLKKLPQMDMMAVDAEKLIALKPQIVYVNDINLASSESVWKQVEDAGITVVNIPTSTSIKAIKEDVQFIADSLSEHEKGQKLIKTMDQEIDE

SEQ ID NO: 127 - DNA, 460 bp; double-stranded, linear
ctcttctgaaaaaacagaagtaacgttaccaaccaaagaccgtagcggcaaagaaattactttacccaaagaagcaaccaaaattatttccctagtgccatcaacaacagaagtgattgaagacttaggtaaaaccgaccaattaatcgcagttgatactcaaagtagtacaatgatgactgatttaaaaaaattaccacaaatggatatgatggctgtcgatgccgaaaaattgattgccttgaaaccacaaattgtttatgtgaatgacatcaatttagctagctcagaaagtgtttggaagcaagtggaagatgctggaattacagtcgttaatatccccactagtacaagcatcaaagcaatcaaagaagacgtccaattcatcgctgatagcttatctgaacatgaaaaaggacaaaagttaatcaaaacaatggatcaagaaatcgacgagtag

SEQ ID NO: 128 - protein, 152 aa
SSEKTEVTLPTKDRSGKEITLPKEATKIISLVPSTTEVIEDLGKTDQLIAVDTQSSTMMTDLKKLPQMDMMAVDAEKLIALKPQIVYVNDINLASSESVWKQVEDAGITVVNIPTSTSIKAIKEDVQFIADSLSEHEKGQKLIKTMDQEIDE

SEQ ID NO: 129 - DNA, 432 bp; double-stranded, linear
taggagggagtaatcatgaaaaaaatcgggtattttagttgtattatttttttcatgtttttggtaggttgtagtaataacaaaaaagaaaacggcaatcttttgaatgccagttcgtttcctttaatactcaccacgattattgaaaaagaagaagacctaacgaaaggttcaatttttttcaacaaggataaaaccatgacgcttgaaaaagaatatttagttaatcccaataatgaagacacaaaaaaaacaagtagaacagaaaaaaaggtatataaaaatattaaaatacaagaaaataaagagagctatgaaattataggtcaattggacaaaaaaacgaaaaaaatagagtttaaaaaagttgatgaaggtaaacgtatatctgatgcagaaggtaatgtgtatggtgattttggtggtaaatag

SEQ ID NO: 130 - protein, 138 aa
MKKIGYFSCIIFFMFLVGCSNNKKENGNLLNASSFPLILTTIIEKEEDLTKGSIFFNKDKTMTLEKEYLVNPNNEDTKKTSRTEKKVYKNIKIQENKESYEIIGQLDKKTKKIEFKKVDEGKRISDAEGNVYGDFGGK

SEQ ID NO: 131 - DNA, 346 bp; double-stranded, linear
agaaaacggcaatcttttgaatgccagttcgtttcctttaatactcaccacgattattgaaaaagaagaagacctaacgaaaggttcaatttttttcaacaaggataaaaccatgacgcttgaaaaagaatatttagttaatcccaataatgaagacacaaaaaaaacaagtagaacagaaaaaaaggtatataaaaatattaaaatacaagaaaataaagagagctatgaaattataggtcaattggacaaaaaaacgaaaaaaatagagtttaaaaaagttgatgaaggtaaacgtatatctgatgcagaaggtaatgtgtatggtgattttggtggtaaatag

SEQ ID NO: 132 - protein, 115 aa
KENGNLLNASSFPLILTTIIEKEEDLTKGSIFFNKDKTMTLEKEYLVNPNNEDTKKTSRTEKKVYKNIKIQENKESYEIIGQLDKKTKKIEFKKVDEGKRISDAEGNVYGDFGGK

SEQ ID NO: 133 - DNA, 261 bp; double-stranded, linear
taaacgagaggtgagtttatgaaaacaaaaatcggaaaaacagttatcttgtcagcatttttattcacaagtttccttttactgagtggttgtacctcggctggcgaagagatggaaaaaacaattgatcgacagaaagaaaaagtcgataaaacggtcgataagcagaaacataaaaatgaaaattccatggaaagttacgacgaaaaagttgaccgttctttagatagtcaagaagacaaaatcgatactactgagtaa

SEQ ID NO: 134 - protein, 80 aa
MKTKIGKTVILSAFLFTSFLLLSGCTSAGEEMEKTIDRQKEKVDKTVDKQKHKNENSMESYDEKVDRSLDSQEDKIDTTE

SEQ ID NO: 135 - DNA, 148 bp; double-stranded, linear
gatggaaaaaacaattgatcgacagaaagaaaaagtcgataaaacggtcgataagcagaaacataaaaatgaaaattccatggaaagttacgacgaaaaagttgaccgttctttagatagtcaagaagacaaaatcgatactactgag

SEQ ID NO: 136 - protein, 49 aa
MEKTIDRQKEKVDKTVDKQKHKNENSMESYDEKVDRSLDSQEDKIDTTE

SEQ ID NO: 137 - DNA, 924 bp; double-stranded, linear
taattttcaagtcctacatataatggtaaaatagaatggattgaaattaattggaggaataatgaatcgatgaaaaaaagattgctattatttattggtttggcaagtatacttactttgacaggatgtgcaaaatggattgatcgtggtgaatccatcacagcggtaggctcatcagctttacaaccattagtagagacagcgagtgaggaatatcaaagccaaaatccgggaagatttattaatgtccaaggtggcggaagcggaacaggtctgagtcaagtccaatctggcgcggtagacattggtaattctgatttatttgcagaagagaaaaagggcatcaaagcggaagacttaattgatcataaagttgctgtcgttgggattacaccaatcgttaacaaaaatgtcggtgtcaaagatatctcaatggaaaatttaaagaaaatctttttaggtgaagtaacaaactggaaagaacttggcgggaaagaccaaaaaattgttattttgaatagagcggccggtagtggtacgcgtgcgacttttgaaaagtgggtcttgggagataaaacagccattcgtgcgcaagaacaagattccagcggcatggttcgttccattgtttctgatacaccaggagcgattagttataccgcattttcatatgttactgatgaagtagctacgttaagtattgatggtgttcagccaacagatgaaaatgtaatgaacaataaatggattatttggtcttatgaacacatgtacactcgtaaaaatccaagtgatttaaccaaagagtttttagactttatgttgtcagatgatatccaagaacgtgtgattggtcaattagggtatattcctgtttcgaaaatggaaattgaacgggattggcaaggaaatgtcattaaataa

SEQ ID NO: 138 - protein, 284 aa
MKKRLLLFIGLASILTLTGCAKWIDRGESITAVGSSALQPLVETASEEYQSQNPGRFINVQGGGSGTGLSQVQSGAVDIGNSDLFAEEKKGIKAEDLIDHKVAVVGITPIVNKNVGVKDISMENLKKIFLGEVTNWKELGGKDQKIVILNRAAGSGTRATFEKWVLGDKTAIRAQEQDSSGMVRSIVSDTPGAISYTAFSYVTDEVATLSIDGVQPTDENVMNNKWIIWSYEHMYTRKNPSDLTKEFLDFMLSDDIQERVIGQLGYIPVSKMEIERDWQGNVIK

SEQ ID NO: 139 - DNA, 784 bp; double-stranded, linear
gattgatcgtggtgaatccatcacagcggtaggctcatcagctttacaaccattagtagagacagcgagtgaggaatatcaaagccaaaatccgggaagatttattaatgtccaaggtggcggaagcggaacaggtctgagtcaagtccaatctggcgcggtagacattggtaattctgatttatttgcagaagagaaaaagggcatcaaagcggaagacttaattgatcataaagttgctgtcgttgggattacaccaatcgttaacaaaaatgtcggtgtcaaagatatctcaatggaaaatttaaagaaaatctttttaggtgaagtaacaaactggaaagaacttggcgggaaagaccaaaaaattgttattttgaatagagcggccggtagtggtacgcgtgcgacttttgaaaagtgggtcttgggagataaaacagccattcgtgcgcaagaacaagattccagcggcatggttcgttccattgtttctgatacaccaggagcgattagttataccgcattttcatatgttactgatgaagtagctacgttaagtattgatggtgttcagccaacagatgaaaatgtaatgaacaataaatggattatttggtcttatgaacacatgtacactcgtaaaaatccaagtgatttaaccaaagagtttttagactttatgttgtcagatgatatccaagaacgtgtgattggtcaattagggtatattcctgtttcgaaaatggaaattgaacgggattggcaaggaaatgtcattaaa

SEQ ID NO: 140 - protein, 261 aa
IDRGESITAVGSSALQPLVETASEEYQSQNPGRFINVQGGGSGTGLSQVQSGAVDIGNSDLFAEEKKGIKAEDLIDHKVAVVGITPIVNKNVGVKDISMENLKKIFLGEVTNWKELGGKDQKIVILNRAAGSGTRATFEKWVLGDKTAIRAQEQDSSGMVRSIVSDTPGAISYTAFSYVTDEVATLSIDGVQPTDENVMNNKWIIWSYEHMYTRKNPSDLTKEFLDFMLSDDIQERVIGQLGYIPVSKMEIERDWQGNVIK

SEQ ID NO: 141 - DNA, 644 bp; double-stranded, linear
tgagtgtatgattactcatttccctttgaatcagttatgataaaggaagaaataaataaattttttggagggattttcatgaaaatgtctaaagtactcaccactgttttgacggcaactgctgctcttgtgttgcttagtgcttgttcatctgataaaaaaacagatagtagttctagtagcaaagaaacagctaattcaagtacagaagtagtctctggtgcttcaattagtgccaagcctgaagagctcgaaatggcgttaagtgataaaggaaattggattgtcgcagctactgacaatgtcacttttgataaagaggtaacagttgctggtactttccatgataaggggaaagattccaacgatgtctatcgtaaattagcactttattcccaagatgataataaaaaagtaactgctgaatatgaaatcacggttcctaagctaatcgtttcttctgaaaatttcaacatcgttcacgggactgtcaaaggtgatattgaggtgaaagcaaatggctttactttaaatggtaccaaagttaatggcaatattacttttgataaacaagaatacaaagattctgctgacttagaaaaagatggtgccactgttactggtgaagtcaccgtagccaataa

SEQ ID NO: 142 - protein, 189 aa; identical to SEQ ID NO: 98

SEQ ID NO: 143 - DNA, 480 bp; double-stranded, linear
aacagatagtagttctagtagcaaagaaacagctaattcaagtacagaagtagtctctggtgcttcaattagtgccaagcctgaagagctcgaaatggcgttaagtgataaaggaaattggattgtcgcagctactgacaatgtcacttttgataaagaggtaacagttgctggtactttccatgataaggggaaagattccaacgatgtctatcgtaaattagcactttattcccaagatgataataaaaaagtaactgctgaatatgaaatcacggttcctaagctaatcgtttcttctgaaaatttcaacatcgttcacgggactgtcaaaggtgatattgaggtgaaagcaaatggctttactttaaatggtaccaaagttaatggcaatattacttttgataaacaagaatacaaagattctgctgacttagaaaaagatggtgccactgttactggtgaagtcaccgtagccaa

SEQ ID NO: 144 - protein, 161 aa; identical to SEQ ID NO: 100

SEQ ID NO: 145 - DNA, 441 bp; double-stranded, linear
taatggccatttcgtctactaataaagaggatgaagctactcaaatggcgttggcaatggaacaaggatcataaaaaaggagaagtgagcatgaaaaaagtactaccttttattgccttagtcggcttgttattgttgtcaggttgtggaacagatatgaaaaagatattgactgccgatggtggtaaatgggaactagaaaataaaagtccaactactacttacactttttttgatgatgaaactttttcgaggtataattcaaaaattagtgatagtggaacgtactcttacgatgaaaataataaaaaactcactttggatataaaaaataaagaacaattaataatggaaaatgttgaatataaagacggtaaattaaaaggtgaaattggaggcgagaaggactctgataaaaaatngaataagaggtgtctttga

SEQ ID NO: 146 - protein, 136 aa
MKLLKWRWQWNKDHKKGEVSMKKVLPFIALVGLLLLSGCGTDMKKILTADGGKWELENKSPTTTYTFFDDETFSRYNSKISDSGTYSYDENNKKLTLDIKNKEQLIMENVEYKDGKLKGEIGGEKDSDKKXNKRCL

SEQ ID NO: 147 - DNA, 298 bp; double-stranded, linear
ttgtggaacagatatgaaaaagatattgactgccgatggtggtaaatgggaactagaaaataaaagtccaactactacttacactttttttgatgatgaaactttttcgaggtataattcaaaaattagtgatagtggaacgtactcttacgatgaaaataataaaaaactcactttggatataaaaaataaagaacaattaataatggaaaatgttgaatataaagacggtaaattaaaaggtgaaattggaggcgagaaggactctgataaaaaatngaataagaggtgtctttga

SEQ ID NO: 148 - protein, 98 aa
CGTDMKKILTADGGKWELENKSPTTTYTFFDDETFSRYNSKISDSGTYSYDENNKKLTLDIKNKEQLIMENVEYKDGKLKGEIGGEKDSDKKXNKRCL

SEQ ID NO: 149 - DNA, 1014 bp; double-stranded, linear
taaatatatcaaaaagaaaaaaggggattaccaaccatgaaaaagaaaaaagtttttagtgcgcttaccttattaacctttagtacgttgttgattgcaggctgtgctggcggagccaactctgcaacagataaatcaagtgcagctagctcaagcactgcagtctctagttcagcagaagcagctaaagagcaatcaaaaggacaagaattaacagaaattttatccagtactgattggcaaggcacaaaagtttacgacaaaaatnataataatttaacagcagaaaatgctaattttattggtttagcaaaatatgatggtgaaacaggtttttatgaatttttcgacaaagaaacaggtgaaacccgtggcgatgaaggcacattctttgtgacagacgatggcgaaaagcgtatcttaatttcggatacacaaaactatcaagcggtggtcgatttaacggaagtgacgaaagataaatttacctataagcgaatgggtaaagataaagacgggaaagatgtagaagtctttgtagaacatatcccttattctgacgagaaattaacctttacgaacggccgtaaagatttagaaacagaaactggcaagattgttaccaatgaacctggggatgacattttaggggccacattatggaatggcacgaaagttttagatgaagacggtaacgatgttactgaagcaaataaaatgtttattagtttagcgaaatttgataataaaacaagtaaatatgaattctttgatttagaaacgggtaaaacacgtggagattttggttacttccaagtaattgataataacaaaatccgtgctcacgtttcaattggtgacaataaatatggagctgcattagaattaacagaattaaatgataaacgttttacgtatacacgaatgggtaaagacaacaatggcaaagaaattaaagtctttgtagaacatgaaccatatgaaggagactttacgccagacttcacgttctaa

SEQ ID NO: 150 - protein, 325 aa
MKKKKVFSALTLLTFSTLLIAGCAGGANSATDKSSAASSSTAVSSSAEAAKEQSKGQELTEILSSTDWQGTKVYDKNXNNLTAENANFIGLAKYDGETGFYEFFDKETGETRGDEGTFFVTDDGEKRILISDTQNYQAVVDLTEVTKDKFTYKRMGKDKDGKDVEVFVEHIPYSDEKLTFTNGRKDLETETGKIVTNEPGDDILGATLWNGTKVLDEDGNDVTEANKMFISLAKFDNKTSKYEFFDLETGKTRGDFGYFQVIDNNKIRAHVSIGDNKYGAALELTELNDKRFTYTRMGKDNNGKEIKVFVEHEPYEGDFTPDFTF

SEQ ID NO: 151 - DNA, 892 bp; double-stranded, linear
tgcaacagataaatcaagtgcagctagctcaagcactgcagtctctagttcagcagaagcagctaaagagcaatcaaaaggacaagaattaacagaaattttatccagtactgattggcaaggcacaaaagtttacgacaaaaatnataataatttaacagcagaaaatgctaattttattggtttagcaaaatatgatggtgaaacaggtttttatgaatttttcgacaaagaaacaggtgaaacccgtggcgatgaaggcacattctttgtgacagacgatggcgaaaagcgtatcttaatttcggatacacaaaactatcaagcggtggtcgatttaacggaagtgacgaaagataaatttacctataagcgaatgggtaaagataaagacgggaaagatgtagaagtctttgtagaacatatcccttattctgacgagaaattaacctttacgaacggccgtaaagatttagaaacagaaactggcaagattgttaccaatgaacctggggatgacattttaggggccacattatggaatggcacgaaagttttagatgaagacggtaacgatgttactgaagcaaataaaatgtttattagtttagcgaaatttgataataaaacaagtaaatatgaattctttgatttagaaacgggtaaaacacgtggagattttggttacttccaagtaattgataataacaaaatccgtgctcacgtttcaattggtgacaataaatatggagctgcattagaattaacagaattaaatgataaacgttttacgtatacacgaatgggtaaagacaacaatggcaaagaaattaaagtctttgtagaacatgaaccatatgaaggagactttacgccagacttcacgttctaa

SEQ ID NO: 152 - protein, 296 aa
ATDKSSAASSSTAVSSSAEAAKEQSKGQELTEILSSTDWQGTKVYDKNXNNLTAENANFIGLAKYDGETGFYEFFDKETGETRGDEGTFFVTDDGEKRILISDTQNYQAVVDLTEVTKDKFTYKRMGKDKDGKDVEVFVEHIPYSDEKLTFTNGRKDLETETGKIVTNEPGDDILGATLWNGTKVLDEDGNDVTEANKMFISLAKFDNKTSKYEFFDLETGKTRGDFGYFQVIDNNKIRAHVSIGDNKYGAALELTELNDKRFTYTRMGKDNNGKEIKVFVEHEPYEGDFTPDFTF

SEQ ID NO: 153 - DNA, 864 bp; double-stranded, linear
tagattagaaccactggagaaaaatctcatatttctctcgaggaaaggaagttgagcacaatgaacaaaaaaattttaatggggctattaagtgtcgtgaccattccattacttgctgcgtgtcaaggaggagaaacaccttccgcagcgtcaaaaaatagtcaaacggtgactactcaaagtagtgcaaaaactgaaagcaccagtacaacccgttcggtagctcaaacaacatcaaaagaggaagtgaaagaaccgatgaagacctatgaagtgggtgcgcttttagaagcagccaatcaacgagatacgaagaaggtcaaggaaattttacaagatactacttatcaagtggatgaagtcgacacagaaggcaacacaccgctcaatatcgctgttcacaataatgacattgagattgcaaaagcgttgattgatcggggtgccgatattaatctgcaaaacagcattagtgatagtccctatctttatgcgggagcgcaaggacgtacggagattttagcgtatatgttaaaacatgcgaccccagatttaaataagcataaccgttacggtggcaatgcgttaattccggcagctgaaaaaggacatattgacaatgtgaagctcttgttagaagatggacgagaagacatagatttccaaaatgactttggctatacagcattgattgaggcagtggggttacgtgaagggaaccaactttaccaagatattgtaaaattgttaatggaaaatggtgcggatcaatccattaaagacaattctggtcgaacagcaatggactatgccaatcaaaaaggttatacggaaattagtaaaattttagcacagtacaactaa

SEQ ID NO: 154 - protein, 267 aa
MNKKILMGLLSVVTIPLLAACQGGETPSAASKNSQTVTTQSSAKTESTSTTRSVAQTTSKEEVKEPMKTYEVGALLEAANQRDTKKVKEILQDTTYQVDEVDTEGNTPLNIAVHNNDIEIAKALIDRGADINLQNSISDSPYLYAGAQGRTEILAYMLKHATPDLNKHNRYGGNALIPAAEKGHIDNVKLLLEDGREDIDFQNDFGYTALIEAVGLREGNQLYQDIVKLLMENGADQSIKDNSGRTAMDYANQKGYTEISKILAQYN

SEQ ID NO: 155 - DNA, 715 bp; double-stranded, linear
agcgtcaaaaaatagtcaaacggtgactactcaaagtagtgcaaaaactgaaagcaccagtacaacccgttcggtagctcaaacaacatcaaaagaggaagtgaaagaaccgatgaagacctatgaagtgggtgcgcttttagaagcagccaatcaacgagatacgaagaaggtcaaggaaattttacaagatactacttatcaagtggatgaagtcgacacagaaggcaacacaccgctcaatatcgctgttcacaataatgacattgagattgcaaaagcgttgattgatcggggtgccgatattaatctgcaaaacagcattagtgatagtccctatctttatgcgggagcgcaaggacgtacggagattttagcgtatatgttaaaacatgcgaccccagatttaaataagcataaccgttacggtggcaatgcgttaattccggcagctgaaaaaggacatattgacaatgtgaagctcttgttagaagatggacgagaagacatagatttccaaaatgactttggctatacagcattgattgaggcagtggggttacgtgaagggaaccaactttaccaagatattgtaaaattgttaatggaaaatggtgcggatcaatccattaaagacaattctggtcgaacagcaatggactatgccaatcaaaaaggttatacggaaattagtaaaattttagcacagtacaac

SEQ ID NO: 156 - protein, 238 aa
ASKNSQTVTTQSSAKTESTSTTRSVAQTTSKEEVKEPMKTYEVGALLEAANQRDTKKVKEILQDTTYQVDEVDTEGNTPLNIAVHNNDIEIAKALIDRGADINLQNSISDSPYLYAGAQGRTEILAYMLKHATPDLNKHNRYGGNALIPAAEKGHIDNVKLLLEDGREDIDFQNDFGYTALIEAVGLREGNQLYQDIVKLLMENGADQSIKDNSGRTAMDYANQKGYTEISKILAQYN

SEQ ID NO: 157 - DNA, 1089 bp; double-stranded, linear
taattattaanttctgatttttcagaaaatacagattgcattattttaggaggcaacactatgaaattgaaaaagtcattaacattcggtgtgattacattatttagcgtaacaactttagcggcttgtggaggcggcggaacgtcagatagctcaagcgcgtctggtggcggtaaggcaagtggcgaacaagttttacgtgtcacagaacaacaagaaatgccaacagctgatttatcactagcaacagncagaattagttttattgcattaaataatgtatatgaaggaatttatcgtttagacaaagataacaaagtccaacctgcaggtgcagcggaaaaagcagaagtttctgaagatggactaacatacaaaattaaattaaataaagatgcaaaatggtcagacggtaaaccagtgactgctaatgactatgtttacggatggcaacgaacagttgatccagcgacagcttctgaatatgcttatctgtatgcctctgtaaaaaatggtgatgccattgctaaaggggaaaaagataaatcagaattaggaattaaagcagtcagtgatacagaattagaaatcactttagaaaaagcaacaccatactttgattacttattagctttcccatcattcttcccgcaacgtcaagacattgtggaaaaatatggtaaaaattatgcatcaaacagcgaaagtgctgtctacaatggtccattcgtcttagacggctttgatggtcctggtacagatacaaaatggtcattcaagaaaaacgatcaatattgggataaagatactgtgaaactggactcagtagatgtgaatgtcgtgaaagaatcaccaaccgcgttgaacttgttccaagatggacaaacagacgatgtcgttctttctggtgaattagcccaacaaatggccaatgacccagcttttgttagtcaaaaagaagcatcaacacaatatatggaactaaatcaacgtgatgaaaaatcaccatttagaaatgcgaacttacgtaaagcaatttcttactcaatcgaccgtaaagcgttagttgaatcaatccttaggggatgg

SEQ ID NO: 158 - protein, 343 aa
MKLKKSLTFGVITLFSVTTLAACGGGGTSDSSSASGGGKASGEQVLRVTEQQEMPTADLSLATXRISFIALNNVYEGIYRLDKDNKVQPAGAAEKAEVSEDGLTYKIKLNKDAKWSDGKPVTANDYVYGWQRTVDPATASEYAYLYASVKNGDAIAKGEKDKSELGIKAVSDTELEITLEKATPYFDYLLAFPSFFPQRQDIVEKYGKNYASNSESAVYNGPFVLDGFDGPGTDTKWSFKKNDQYWDKDTVKLDSVDVNVVKESPTALNLFQDGQTDDVVLSGELAQQMANDPAFVSQKEASTQYMELNQRDEKSPFRNANLRKAISYSIDRKALVESILRGW

SEQ ID NO: 159 - DNA, 964 bp; double-stranded, linear
ttgtggaggcggcggaacgtcagatagctcaagcgcgtctggtggcggtaaggcaagtggcgaacaagttttacgtgtcacagaacaacaagaaatgccaacagctgatttatcactagcaacagncagaattagttttattgcattaaataatgtatatgaaggaatttatcgtttagacaaagataacaaagtccaacctgcaggtgcagcggaaaaagcagaagtttctgaagatggactaacatacaaaattaaattaaataaagatgcaaaatggtcagacggtaaaccagtgactgctaatgactatgtttacggatggcaacgaacagttgatccagcgacagcttctgaatatgcttatctgtatgcctctgtaaaaaatggtgatgccattgctaaaggggaaaaagataaatcagaattaggaattaaagcagtcagtgatacagaattagaaatcactttagaaaaagcaacaccatactttgattacttattagctttcccatcattcttcccgcaacgtcaagacattgtggaaaaatatggtaaaaattatgcatcaaacagcgaaagtgctgtctacaatggtccattcgtcttagacggctttgatggtcctggtacagatacaaaatggtcattcaagaaaaacgatcaatattgggataaagatactgtgaaactggactcagtagatgtgaatgtcgtgaaagaatcaccaaccgcgttgaacttgttccaagatggacaaacagacgatgtcgttctttctggtgaattagcccaacaaatggccaatgacccagcttttgttagtcaaaaagaagcatcaacacaatatatggaactaaatcaacgtgatgaaaaatcaccatttagaaatgcgaacttacgtaaagcaatttcttactcaatcgaccgtaaagcgttagttgaatcaatccttaggggatgg

SEQ ID NO: 160 - protein, 321 aa
CGGGGTSDSSSASGGGKASGEQVLRVTEQQEMPTADLSLATXRISFIALNNVYEGIYRLDKDNKVQPAGAAEKAEVSEDGLTYKIKLNKDAKWSDGKPVTANDYVYGWQRTVDPATASEYAYLYASVKNGDAIAKGEKDKSELGIKAVSDTELEITLEKATPYFDYLLAFPSFFPQRQDIVEKYGKNYASNSESAVYNGPFVLDGFDGPGTDTKWSFKKNDQYWDKDTVKLDSVDVNVVKESPTALNLFQDGQTDDVVLSGELAQQMANDPAFVSQKEASTQYMELNQRDEKSPFRNANLRKAISYSIDRKALVESILRGW

SEQ ID NO: 161 - DNA, 732 bp; double-stranded, linear
taagataaaattagttatagcgtctataggaggaatagtatgaaaaaattagtttgtgttattttagttatttttttaacaggttgtagttctcaaaaagcgaatgaacctaaaaaacaagaaaattctaccaatcatacaacatcaataaaaagcagtactaatcattacagttctagcatagaaacaagctctaataataaactaaaagaaacttcagaaagtgccagcaccactcaaacttcgtcaaagtcgaaaaatgaagtatctacaaatgtcgaagaagcaaattctttagaagcaacaccttatgctgtcgatcttagtagcttaaacaatccactcgtatttaattttaaaggaatgaatgtgccaacttcaattacgttagagaacttaaattcaacaccaactgctaccttccgaactaaattgtttggggctgaaaatggtcaagtgaaagaagccattaataaatatgagctatctataaatacaattcctacaaaagagattagaatattttcagcggccgataacagtattcgcaccgttaaagtaaatacagaattaattttaggaactaatatttcttcaaacgatgaacaaaatagatcgggcactttatacttattcaacaataaaaatggttcgatatctttaatcactcctaactacgctggcaatgttacggatgatcaaaaagacgttatgctagaagtaattcaataa

SEQ ID NO: 162 - protein, 230 aa
MKKLVCVILVIFLTGCSSQKANEPKKQENSTNHTTSIKSSTNHYSSSIETSSNNKLKETSESASTTQTSSKSKNEVSTNVEEANSLEATPYAVDLSSLNNPLVFNFKGMNVPTSITLENLNSTPTATFRTKLFGAENGQVKEAINKYELSINTIPTKEIRIFSAADNSIRTVKVNTELILGTNISSNDEQNRSGTLYLFNNKNGSISLITPNYAGNVTDDQKDVMLEVIQ

SEQ ID NO: 163 - DNA, 646 bp; double-stranded, linear
ttgtagttctcaaaaagcgaatgaacctaaaaaacaagaaaattctaccaatcatacaacatcaataaaaagcagtactaatcattacagttctagcatagaaacaagctctaataataaactaaaagaaacttcagaaagtgccagcaccactcaaacttcgtcaaagtcgaaaaatgaagtatctacaaatgtcgaagaagcaaattctttagaagcaacaccttatgctgtcgatcttagtagcttaaacaatccactcgtatttaattttaaaggaatgaatgtgccaacttcaattacgttagagaacttaaattcaacaccaactgctaccttccgaactaaattgtttggggctgaaaatggtcaagtgaaagaagccattaataaatatgagctatctataaatacaattcctacaaaagagattagaatattttcagcggccgataacagtattcgcaccgttaaagtaaatacagaattaattttaggaactaatatttcttcaaacgatgaacaaaatagatcgggcactttatacttattcaacaataaaaatggttcgatatctttaatcactcctaactacgctggcaatgttacggatgatcaaaaagacgttatgctagaagtaattcaa

SEQ ID NO: 164 - protein, 215 aa
CSSQKANEPKKQENSTNHTTSIKSSTNHYSSSIETSSNNKLKETSESASTTQTSSKSKNEVSTNVEEANSLEATPYAVDLSSLNNPLVFNFKGMNVPTSITLENLNSTPTATFRTKLFGAENGQVKEAINKYELSINTIPTKEIRIFSAADNSIRTVKVNTELILGTNISSNDEQNRSGTLYLFNNKNGSISLITPNYAGNVTDDQKDVMLEVIQ

SEQ ID NO: 165 - DNA, 1809 bp; double-stranded, linear
tagccaaaaaatgagggaggaaaagagatgaacaagaaacggattttaggtgcaatcacgttagcttctgtgttagtattcgggttagctgcatgtggtggcggcaataaaggcgggggcaataaagcaacggaaacagaagacatttcaaaaatgccaatcgctgttaaaaatgataaaaaagcaattgatggcggtacattagatgtcgctgtagttatggatacacaattccaaggacttttccagcaagaattttatcaagacaactatgatgcacaatacatgcttccaacggtacagccattatttaacaatgatgcagactttaagattgtcgatgggggtcctgcggatctgaaattagatgaagatgccaatacagcaaccattaaattacgtgacaatttgaaatggtctgacggtaaagatgtgacagccgatgacgtgattttctcttatgaagtcattggtcataaagactatacagggattcgttatgatgataactttacgaatattgttggcatggaagactaccatgatggtaaatcgccaaccatttctggcatagaaaaagtcaatgataaagaagttaaaatcacttataaagaagttcacccaggaatgcaacaattaggtggcggtgtttggggctcagttttaccaaaacatgcctttgaaggaattgctgttaaagacatggaatcaagcgatgcagttcgtaaaaaccctgtgactattggaccatactacatgagtaatattgtgacaggtgaatctgttgaatacctaccaaatgagcattactacggtggtaaacctaaattagataaattagtgttcaaatctgttccttctgcgagcattgtagaagcgatgaaagcgaaacaatacgatattgcattatcaatgccaacagatacgtatccaacatacaaagatactgaagggtatcaaatcttaggacgtcccgaacaagcctacacgtatattggctttaaaatgggtacgtttgacaaagaaacaaatacagtgaaatacaatccaaaagctaaaatggcagataaaagcttacgtcaagccatgggctatgcaattgacaatgatgcagtcggccaaaaattctacaacggcttacgaacaggggcaacaacgttaatcccaccagtcttcaagagcttgcatgatagcgaagcgaaaggctatacgcttgatttagacaaagcgaaaaaattattagacgatgctggttataaagacgtagacggcgatggcattcgcgaagacaaagaaggcaaaccactagaaatcaagtttgcttcaatgtcaggcggcgaaactgcacaaccacttgctgattactatgtccaacaatggaaagaaattggcttaaacgtaacgtatacaacaggacgcttaattgatttccaagcattctatgataaattgaaaaatgatgacccagaagtagatatctatcaaggcgcgtggggcacaggttcagatccttcaccaaccggcttatatggtccaaactcagcctttaactatacacgttttgagtcagaagaaaatactaaattacttgatgcgattgattcaaaagcatcatttgatgaagaaaaacgtaaaaaagccttctacgattggcaagagtatgccattgatgaagcgtttgtaatcccaacgctttacagaaatgaagtcttgcctgtcaacgaccgtgtagttgactttacttgggcagttgatacgaaagataatccatgggcaacggtgggtgtcacagcagactcacggaaataa

SEQ ID NO: 166 - protein, 593 aa
MNKKRILGAITLASVLVFGLAACGGGNKGGGNKATETEDISKMPIAVKNDKKAIDGGTLDVAVVMDTQFQGLFQQEFYQDNYDAQYMLPTVQPLFNNDADFKIVDGGPADLKLDEDANTATIKLRDNLKWSDGKDVTADDVIFSYEVIGHKDYTGIRYDDNFTNIVGMEDYHDGKSPTISGIEKVNDKEVKITYKEVHPGMQQLGGGVWGSVLPKHAFEGIAVKDMESSDAVRKNPVTIGPYYMSNIVTGESVEYLPNEHYYGGKPKLDKLVFKSVPSASIVEAMKAKQYDIALSMPTDTYPTYKDTEGYQILGRPEQAYTYIGFKMGTFDKETNTVKYNPKAKMADKSLRQAMGYAIDNDAVGQKFYNGLRTGATTLIPPVFKSLHDSEAKGYTLDLDKAKKLLDDAGYKDVDGDGIREDKEGKPLEIKFASMSGGETAQPLADYYVQQWKEIGLNVTYTTGRLIDFQAFYDKLKNDDPEVDIYQGAWGTGSDPSPTGLYGPNSAFNYTRFESEENTKLLDAIDSKASFDEEKRKKAFYDWQEYAIDEAFVIPTLYRNEVLPVNDRVVDFTWAVDTKDNPWATVGVTADSRK

SEQ ID NO: 167 - DNA, 1714 bp; double-stranded, linear
atgtggtggcggcaataaaggcgggggcaataaagcaacggaaacagaagacatttcaaaaatgccaatcgctgttaaaaatgataaaaaagcaattgatggcggtacattagatgtcgctgtagttatggatacacaattccaaggacttttccagcaagaattttatcaagacaactatgatgcacaatacatgcttccaacggtacagccattatttaacaatgatgcagactttaagattgtcgatgggggtcctgcggatctgaaattagatgaagatgccaatacagcaaccattaaattacgtgacaatttgaaatggtctgacggtaaagatgtgacagccgatgacgtgattttctcttatgaagtcattggtcataaagactatacagggattcgttatgatgataactttacgaatattgttggcatggaagactaccatgatggtaaatcgccaaccatttctggcatagaaaaagtcaatgataaagaagttaaaatcacttataaagaagttcacccaggaatgcaacaattaggtggcggtgtttggggctcagttttaccaaaacatgcctttgaaggaattgctgttaaagacatggaatcaagcgatgcagttcgtaaaaaccctgtgactattggaccatactacatgagtaatattgtgacaggtgaatctgttgaatacctaccaaatgagcattactacggtggtaaacctaaattagataaattagtgttcaaatctgttccttctgcgagcattgtagaagcgatgaaagcgaaacaatacgatattgcattatcaatgccaacagatacgtatccaacatacaaagatactgaagggtatcaaatcttaggacgtcccgaacaagcctacacgtatattggctttaaaatgggtacgtttgacaaagaaacaaatacagtgaaatacaatccaaaagctaaaatggcagataaaagcttacgtcaagccatgggctatgcaattgacaatgatgcagtcggccaaaaattctacaacggcttacgaacaggggcaacaacgttaatcccaccagtcttcaagagcttgcatgatagcgaagcgaaaggctatacgcttgatttagacaaagcgaaaaaattattagacgatgctggttataaagacgtagacggcgatggcattcgcgaagacaaagaaggcaaaccactagaaatcaagtttgcttcaatgtcaggcggcgaaactgcacaaccacttgctgattactatgtccaacaatggaaagaaattggcttaaacgtaacgtatacaacaggacgcttaattgatttccaagcattctatgataaattgaaaaatgatgacccagaagtagatatctatcaaggcgcgtggggcacaggttcagatccttcaccaaccggcttatatggtccaaactcagcctttaactatacacgttttgagtcagaagaaaatactaaattacttgatgcgattgattcaaaagcatcatttgatgaagaaaaacgtaaaaaagccttctacgattggcaagagtatgccattgatgaagcgtttgtaatcccaacgctttacagaaatgaagtcttgcctgtcaacgaccgtgtagttgactttacttgggcagttgatacgaaagataatccatgggcaacggtgggtgtcacagcagactcacggaaa

SEQ ID NO: 168 - protein, 571 aa
CGGGNKGGGNKATETEDISKMPIAVKNDKKAIDGGTLDVAVVMDTQFQGLFQQEFYQDNYDAQYMLPTVQPLFNNDADFKIVDGGPADLKLDEDANTATIKLRDNLKWSDGKDVTADDVIFSYEVIGHKDYTGIRYDDNFTNIVGMEDYHDGKSPTISGIEKVNDKEVKITYKEVHPGMQQLGGGVWGSVLPKHAFEGIAVKDMESSDAVRKNPVTIGPYYMSNIVTGESVEYLPNEHYYGGKPKLDKLVFKSVPSASIVEAMKAKQYDIALSMPTDTYPTYKDTEGYQILGRPEQAYTYIGFKMGTFDKETNTVKYNPKAKMADKSLRQAMGYAIDNDAVGQKFYNGLRTGATTLIPPVFKSLHDSEAKGYTLDLDKAKKLLDDAGYKDVDGDGIREDKEGKPLEIKFASMSGGETAQPLADYYVQQWKEIGLNVTYTTGRLIDFQAFYDKLKNDDPEVDIYQGAWGTGSDPSPTGLYGPNSAFNYTRFESEENTKLLDAIDSKASFDEEKRKKAFYDWQEYAIDEAFVIPTLYRNEVLPVNDRVVDFTWAVDTKDNPWATVGVTADSRK

SEQ ID NO: 169 - DNA, 378 bp; double-stranded, linear
taggaggatataatgaaaaaaaaacttattgtactattgttagccttatttttaacggcatgtagtaataatactgggggaaaaaatagcgacgcttcatctactgaagtatcaactaagcagcaaactacccagtcttctaaaaaagatagtagtaatccggacacaacaccaacttctacatcatctataacaattgaaacaaccgagaatttaaagaatagagaattgaatccaacagatgatgtttcaaaaactagacgacaattgtatgaacaaggaattaacagttcaacaattacggataaagaactaaaggaatatatatcagaggctaaagaacaaaagaaagatgtcattaattatattaagcaaaaa

SEQ ID NO: 170 - protein, 122 aa
MKKKLIVLLLALFLTACSNNTGGKNSDASSTEVSTKQQTTQSSKKDSSNPDTTPTSTSSITIETTENLKNRELNPTDDVSKTRRQLYEQGINSSTITDKELKEYISEAKEQKKDVINYIKQK

SEQ ID NO: 171 - DNA, 319 bp; double-stranded, linear
atgtagtaataatactgggggaaaaaatagcgacgcttcatctactgaagtatcaactaagcagcaaactacccagtcttctaaaaaagatagtagtaatccggacacaacaccaacttctacatcatctataacaattgaaacaaccgagaatttaaagaatagagaattgaatccaacagatgatgtttcaaaaactagacgacaattgtatgaacaaggaattaacagttcaacaattacggataaagaactaaaggaatatatatcagaggctaaagaacaaaagaaagatgtcattaattatattaagcaaaaa

SEQ ID NO: 172 - protein, 106 aa
CSNNTGGKNSDASSTEVSTKQQTTQSSKKDSSNPDTTPTSTSSITIETTENLKNRELNPTDDVSKTRRQLYEQGINSSTITDKELKEYISEAKEQKKDVINYIKQK

SEQ ID NO: 173 - DNA, 942 bp; double-stranded, linear
tagggaaaacaaggaggaattcttatgaaaaagatagggcttatttctagtgcttttcttttaacccttgctttagcagcatgcggcggcggaaaaagtacagaaaatacggatagtcgttccagtgctgcggaaagtaccacagtcgagagtacaaaagcatctgctacaaaagaatcaagtagcaaagcaacaacaaaatctagtgatgcgaaaccgtcaggaacaacaacagctgattcgaaagcaacagcttcttctacgaaggaagcggcaaataatggctcagcagagaagcaatcaccagcgaaaaatgcgaatccagatgaccaagccaaccaagtgcttaaccagctagcaaacatgtttcctggtcaaggcttaccgcaggcaattttaacgagtcaaacgaataactttttaactgcagcgacaacttcacaagcggatcaaaacaatttccgtgttttatattatgcagaaaaagaagcgattccagtgaatgatgcacgtgtcaatcagttaacgccaattagttcttttgagaaaaaaacatatggctctgatgccgaagcaaaaaatgcagtgaaccaaatcattgacaatggcggtcaaccagtagatttaggttacaatattactgggtataaacaaggggcggcaggttctagttacttatcttggcaagaaggcaattggagtttagtcgtacgggcctcaaatatcaatggtgaatcgcctgatgatttagcgaaaaatgttgtcaacattttggaacaagaaacattaccagcaccgaataccgttggtcaaatcacactgaacgtggcaggaaccactgactataatcgaaactcagtagtttggcaagccggtacagtcgtttactctgtccatcattttgacccaattcaagcagtgaagatggcaacatcaatgtaa

SEQ ID NO: 174 - protein, 305 aa
MKKIGLISSAFLLTLALAACGGGKSTENTDSRSSAAESTTVESTKASATKESSSKATTKSSDAKPSGTTTADSKATASSTKEAANNGSAEKQSPAKNANPDDQANQVLNQLANMFPGQGLPQAILTSQTNNFLTAATTSQADQNNFRVLYYAEKEAIPVNDARVNQLTPISSFEKKTYGSDAEAKNAVNQIIDNGGQPVDLGYNITGYKQGAAGSSYLSWQEGNWSLVVRASNINGESPDDLAKNVVNILEQETLPAPNTVGQITLNVAGTTDYNRNSVVWQAGTVVYSVHHFDPIQAVKMATSM

SEQ ID NO: 175 - DNA, 862 bp; double-stranded, linear
atgcggcggcggaaaaagtacagaaaatacggatagtcgttccagtgctgcggaaagtaccacagtcgagagtacaaaagcatctgctacaaaagaatcaagtagcaaagcaacaacaaaatctagtgatgcgaaaccgtcaggaacaacaacagctgattcgaaagcaacagcttcttctacgaaggaagcggcaaataatggctcagcagagaagcaatcaccagcgaaaaatgcgaatccagatgaccaagccaaccaagtgcttaaccagctagcaaacatgtttcctggtcaaggcttaccgcaggcaattttaacgagtcaaacgaataactttttaactgcagcgacaacttcacaagcggatcaaaacaatttccgtgttttatattatgcagaaaaagaagcgattccagtgaatgatgcacgtgtcaatcagttaacgccaattagttcttttgagaaaaaaacatatggctctgatgccgaagcaaaaaatgcagtgaaccaaatcattgacaatggcggtcaaccagtagatttaggttacaatattactgggtataaacaaggggcggcaggttctagttacttatcttggcaagaaggcaattggagtttagtcgtacgggcctcaaatatcaatggtgaatcgcctgatgatttagcgaaaaatgttgtcaacattttggaacaagaaacattaccagcaccgaataccgttggtcaaatcacactgaacgtggcaggaaccactgactataatcgaaactcagtagtttggcaagccggtacagtcgtttactctgtccatcattttgacccaattcaagcagtgaagatggcaacatcaatgtaa

SEQ ID NO: 176 - protein, 286 aa
CGGGKSTENTDSRSSAAESTTVESTKASATKESSSKATTKSSDAKPSGTTTADSKATASSTKEAANNGSAEKQSPAKNANPDDQANQVLNQLANMFPGQGLPQAILTSQTNNFLTAATTSQADQNNFRVLYYAEKEAIPVNDARVNQLTPISSFEKKTYGSDAEAKNAVNQIIDNGGQPVDLGYNITGYKQGAAGSSYLSWQEGNWSLVVRASNINGESPDDLAKNVVNILEQETLPAPNTVGQITLNVAGTTDYNRNSVVWQAGTVVYSVHHFDPIQAVKMATSM

SEQ ID NO: 177 - DNA, 1023 bp; double-stranded, linear
taaggagaaaagttcatgaaaaaaagaaaggttttatttacagcagttatggtattggcaggattacagttgctaagtggttgcggcaaaacagaagcttcggcaaatgatacggtagtcttgcgctatgcgtatgctagtaatagccaaccagttatcgattctatgaagaaattcggtgaattagtagaggaaaaaacagatggtaaagttcaaattgaatattttccagatggtcaattaggaggagaaacagaactaattgaattaacacaaacaggtgcaattgattttgcaaaggtcagtggatcagcattagaaagtttttctaaagattattctgtatttgccattccgtatatttttgataatgaaaaacatttttttaaagtaatggataatcaagcgctaatgcaaccagtgtatgattctacaaaaaaattaggatttgttggtttaacttattatgactctggtcaacgaagtttttatatgagcaaagggcctgttacatctccagatgatttgaaaggtaaaaaaattcgggtcatgcaaagtgaaaccgccatcaaaatggtagaacttttagggggttcgccagtacctatgggtagttcggaagtatatacttctctacaatctaatctaatcaacggtgcagagaataatgagttcgttttatatacagctggtcatggtggtgtggctaagtattattcttatgatgagcatactcgagtgccagatattgtgattatgaacgagggaacaaaagaacgtttgacagcgaaacaagaacaagcgattgaagaagcagcaaaagaatcgaccgcttttgaaaaaacggtctttaaagaagcggttgaagaagaaaagaaaaaagcacaagcagaatatggcgttgtgttcaatcaagtagacagtgaaccattccaaaaacttgttcaaccgttgcatgaatcattcaaaaatagctcagaacatggcgaactgtatcaggctattcgccagttggcggactaa

SEQ ID NO: 178 - protein, 335 aa
MKKRKVLFTAVMVLAGLQLLSGCGKTEASANDTVVLRYAYASNSQPVIDSMKKFGELVEEKTDGKVQIEYFPDGQLGGETELIELTQTGAIDFAKVSGSALESFSKDYSVFAIPYIFDNEKHFFKVMDNQALMQPVYDSTKKLGFVGLTYYDSGQRSFYMSKGPVTSPDDLKGKKIRVMQSETAIKMVELLGGSPVPMGSSEVYTSLQSNLINGAENNEFVLYTAGHGGVAKYYSYDEHTRVPDIVIMNEGTKERLTAKQEQAIEEAAKESTAFEKTVFKEAVEEEKKKAQAEYGVVFNQVDSEPFQKLVQPLHESFKNSSEHGELYQAIRQLAD

SEQ ID NO: 179 - DNA, 943 bp; double-stranded, linear
ttgcggcaaaacagaagcttcggcaaatgatacggtagtcttgcgctatgcgtatgctagtaatagccaaccagttatcgattctatgaagaaattcggtgaattagtagaggaaaaaacagatggtaaagttcaaattgaatattttccagatggtcaattaggaggagaaacagaactaattgaattaacacaaacaggtgcaattgattttgcaaaggtcagtggatcagcattagaaagtttttctaaagattattctgtatttgccattccgtatatttttgataatgaaaaacatttttttaaagtaatggataatcaagcgctaatgcaaccagtgtatgattctacaaaaaaattaggatttgttggtttaacttattatgactctggtcaacgaagtttttatatgagcaaagggcctgttacatctccagatgatttgaaaggtaaaaaaattcgggtcatgcaaagtgaaaccgccatcaaaatggtagaacttttagggggttcgccagtacctatgggtagttcggaagtatatacttctctacaatctaatctaatcaacggtgcagagaataatgagttcgttttatatacagctggtcatggtggtgtggctaagtattattcttatgatgagcatactcgagtgccagatattgtgattatgaacgagggaacaaaagaacgtttgacagcgaaacaagaacaagcgattgaagaagcagcaaaagaatcgaccgcttttgaaaaaacggtctttaaagaagcggttgaagaagaaaagaaaaaagcacaagcagaatatggcgttgtgttcaatcaagtagacagtgaaccattccaaaaacttgttcaaccgttgcatgaatcattcaaaaatagctcagaacatggcgaactgtatcaggctattcgccagttggcggactaa

SEQ ID NO: 180 - protein, 313 aa
CGKTEASANDTVVLRYAYASNSQPVIDSMKKFGELVEEKTDGKVQIEYFPDGQLGGETELIELTQTGAIDFAKVSGSALESFSKDYSVFAIPYIFDNEKHFFKVMDNQALMQPVYDSTKKLGFVGLTYYDSGQRSFYMSKGPVTSPDDLKGKKIRVMQSETAIKMVELLGGSPVPMGSSEVYTSLQSNLINGAENNEFVLYTAGHGGVAKYYSYDEHTRVPDIVIMNEGTKERLTAKQEQAIEEAAKESTAFEKTVFKEAVEEEKKKAQAEYGVVFNQVDSEPFQKLVQPLHESFKNSSEHGELYQAIRQLAD

SEQ ID NO: 181 - DNA, 1110 bp; double-stranded, linear
tgagactctttctttttcaaaatgaggtatggtatagttataacaganataaaactanaaaaaacaggagtgcataagagaatgaagaaaaaactaatcttagctgcagcgggcgcaatggccgtttttagtttagcagcgtgttcaagcggttcaaaagatatcgcaacaatgaaaggttcaacaattactgttgatgatttttataaccaaattaaagaacaaagcactagccaacaagcgtttagccaaatggttatttataaagtctttgaagaaaaatatggcgacaaagtaactgacaaaganattcaaaaaaactttgacgaagccaaagaacaagtagaagcacaaggcggaaagttctctgatgcattaaaacaagctggtttaactgaaaaaacattcaagaaacagttaaaacaaagagcagcctatgatgcaggtctaaaagcccacttaaaaattacagatgaagacttaaaaacagcttgggcaagtttccatccagaagtagaagcacaaattatccaagttgcttcagaagatgatgccaaagctgtcaagaaagaaatcactgacggcggcgatttcacaaaaattgctaaagaaaaatcaacagatactgctacgaaaaaagatggcggtaaaattaaatttgattcacaagcaacaactgttcctgccgaagttaaagaagctgccttcaaattaaaagatggcgaagtgtcagaaccaattgctgcaacaaatatgcaaacctaccaaacaacctactatgtagtgaaaatgacgaaaaacaaagcaaaaggcaatgacatgaaaccttatgaaaaagagatcaagaaaattgctgaagaaacaaaattagccgatcaaacatttgtttcgaaagtcattagtgacgaattaaaagcggccaatgtgaaaattaaagatgatgccttcaagaacgctttagcaggctacatgcaaactgaatcttcaagcgcttcttcagagaaaaaagaatcaaaatcaagtgattctaaaacaagcgataccaaaacaagcgactctgaaaaagcaacagattcttcaagcaaaacaacagaatcttcttctaaataa

SEQ ID NO: 182 - protein, 342 aa
MKKKLILAAAGAMAVFSLAACSSGSKDIATMKGSTITVDDFYNQIKEQSTSQQAFSQMVIYKVFEEKYGDKVTDKXIQKNFDEAKEQVEAQGGKFSDALKQAGLTEKTFKKQLKQRAAYDAGLKAHLKITDEDLKTAWASFHPEVEAQIIQVASEDDAKAVKKEITDGGDFTKIAKEKSTDTATKKDGGKIKFDSQATTVPAEVKEAAFKLKDGEVSEPIAATNMQTYQTTYYVVKMTKNKAKGNDMKPYEKEIKKIAEETKLADQTFVSKVISDELKAANVKIKDDAFKNALAGYMQTESSSASSEKKESKSSDSKTSDTKTSDSEKATDSSSKTTESSSK

SEQ ID NO: 183 - DNA, 970 bp; double-stranded, linear
gtgttcaagcggttcaaaagatatcgcaacaatgaaaggttcaacaattactgttgatgatttttataaccaaattaaagaacaaagcactagccaacaagcgtttagccaaatggttatttataaagtctttgaagaaaaatatggcgacaaagtaactgacaaaganattcaaaaaaactttgacgaagccaaagaacaagtagaagcacaaggcggaaagttctctgatgcattaaaacaagctggtttaactgaaaaaacattcaagaaacagttaaaacaaagagcagcctatgatgcaggtctaaaagcccacttaaaaattacagatgaagacttaaaaacagcttgggcaagtttccatccagaagtagaagcacaaattatccaagttgcttcagaagatgatgccaaagctgtcaagaaagaaatcactgacggcggcgatttcacaaaaattgctaaagaaaaatcaacagatactgctacgaaaaaagatggcggtaaaattaaatttgattcacaagcaacaactgttcctgccgaagttaaagaagctgccttcaaattaaaagatggcgaagtgtcagaaccaattgctgcaacaaatatgcaaacctaccaaacaacctactatgtagtgaaaatgacgaaaaacaaagcaaaaggcaatgacatgaaaccttatgaaaaagagatcaagaaaattgctgaagaaacaaaattagccgatcaaacatttgtttcgaaagtcattagtgacgaattaaaagcggccaatgtgaaaattaaagatgatgccttcaagaacgctttagcaggctacatgcaaactgaatcttcaagcgcttcttcagagaaaaaagaatcaaaatcaagtgattctaaaacaagcgataccaaaacaagcgactctgaaaaagcaacagattcttcaagcaaaacaacagaatcttcttctaaataa

SEQ ID NO: 184 - protein, 322 aa
CSSGSKDIATMKGSTITVDDFYNQIKEQSTSQQAFSQMVIYKVFEEKYGDKVTDKXIQKNFDEAKEQVEAQGGKFSDALKQAGLTEKTFKKQLKQRAAYDAGLKAHLKITDEDLKTAWASFHPEVEAQIIQVASEDDAKAVKKEITDGGDFTKIAKEKSTDTATKKDGGKIKFDSQATTVPAEVKEAAFKLKDGEVSEPIAATNMQTYQTTYYVVKMTKNKAKGNDMKPYEKEIKKIAEETKLADQTFVSKVISDELKAANVKIKDDAFKNALAGYMQTESSSASSEKKESKSSDSKTSDTKTSDSEKATDSSSKTTESSSK

SEQ ID NO: 185 - DNA, 954 bp; double-stranded, linear
tagggtctggaaaagcagtcaactgacttcttttccaagcccttttttagttcatcgcagaaaggatgnaaaaaaatgaacatgcccaaaaatatcngttatttttctttgctaatgggtcttgttctattattaagtgcttgccaaattggggcaactacgaaggatgacaaccaagccgccacaaaagaagcaactgttgagttaaaccgcacaacaacaccaacgcttttttttcatggttacgcaggaactaaaaattcgtttggctcgttactgcatcgcttggagaaacaaggtgccacaactcaagaattagtgctactcgttaaacctgatgggaccgtggttaaagagcgaggagctttaagtggcaaagcgacgaatcccagtgttcaagttctatttgaagataataaaaacaatgaatggaatcaaacagaatggataaaaaacacattactctatttacaaaaaaattatcaagtgaacaaagccaatattgtcgggcactctatgggtggtgttagtggtttacgttatttaggaacctatgggcaagatacatcgttacctaaaattgaaaaattcgtcagcattggagcacctttcaatgattttattgatacgagtcaacagcaaaccatcgaaacggaactagaaaacggccccacagaaaaaagtagccgctatttggattatcaagagatgattaatgttgttccagaaaaactgcccattttattaattggtggtcaattaagtccaacagatttaagtgatggaacggtgccgttatctagtgccttagcagtcaacgccttgctaagacagcgaggaactcaagtcactagccagattattaaaggagaaaatgcacaacatagtcaattacatgaaaatcctgaagtagatcaattgctaatcgaatttctatggccgagtaaaaaatag

SEQ ID NO: 186 - protein, 292 aa
MNMPKNIXYFSLLMGLVLLLSACQIGATTKDDNQAATKEATVELNRTTTPTLFFHGYAGTKNSFGSLLHRLEKQGATTQELVLLVKPDGTVVKERGALSGKATNPSVQVLFEDNKNNEWNQTEWIKNTLLYLQKNYQVNKANIVGHSMGGVSGLRYLGTYGQDTSLPKIEKFVSIGAPFNDFIDTSQQQTIETELENGPTEKSSRYLDYQEMINVVPEKLPILLIGGQLSPTDLSDGTVPLSSALAVNALLRQRGTQVTSQIIKGENAQHSQLHENPEVDQLLIEFLWPSKK

SEQ ID NO: 187 - DNA, 814 bp; double-stranded, linear
ttgccaaattggggcaactacgaaggatgacaaccaagccgccacaaaagaagcaactgttgagttaaaccgcacaacaacaccaacgcttttttttcatggttacgcaggaactaaaaattcgtttggctcgttactgcatcgcttggagaaacaaggtgccacaactcaagaattagtgctactcgttaaacctgatgggaccgtggttaaagagcgaggagctttaagtggcaaagcgacgaatcccagtgttcaagttctatttgaagataataaaaacaatgaatggaatcaaacagaatggataaaaaacacattactctatttacaaaaaaattatcaagtgaacaaagccaatattgtcgggcactctatgggtggtgttagtggtttacgttatttaggaacctatgggcaagatacatcgttacctaaaattgaaaaattcgtcagcattggagcacctttcaatgattttattgatacgagtcaacagcaaaccatcgaaacggaactagaaaacggccccacagaaaaaagtagccgctatttggattatcaagagatgattaatgttgttccagaaaaactgcccattttattaattggtggtcaattaagtccaacagatttaagtgatggaacggtgccgttatctagtgccttagcagtcaacgccttgctaagacagcgaggaactcaagtcactagccagattattaaaggagaaaatgcacaacatagtcaattacatgaaaatcctgaagtagatcaattgctaatcgaatttctatggccgagtaaaaaatag

SEQ ID NO: 188 - protein, 270 aa
CQIGATTKDDNQAATKEATVELNRTTTPTLFFHGYAGTKNSFGSLLHRLEKQGATTQELVLLVKPDGTVVKERGALSGKATNPSVQVLFEDNKNNEWNQTEWIKNTLLYLQKNYQVNKANIVGHSMGGVSGLRYLGTYGQDTSLPKIEKFVSIGAPFNDFIDTSQQQTIETELENGPTEKSSRYLDYQEMINVVPEKLPILLIGGQLSPTDLSDGTVPLSSALAVNALLRQRGTQVTSQIIKGENAQHSQLHENPEVDQLLIEFLWPSKK

SEQ ID NO: 189 - DNA, 822 bp; double-stranded, linear
taaaagaaaagaggcgttcaaatgtctaaacaaaaaaaggctgtgttcctgcttagtttattcagtttagttgccctaattgctgcatgtacaaatcagccgcaaaaagaaacagtttcaacaaaaaaagaagaaataacccttgcggcagcagctagcttagaatcagtcatggagaagaaaattattccagcctttgaaaaagagcatccagatattcaggtaactggaacctatgatagttctggaaaattacagatgcaaattgaaaaaggcctaaaagccgatgtatttttctcagcttcgacaaaacaaatgaatgcattggttgcagaaaaactaattaataaaaaaagtgtcgttcctttattggaaaaccagctcgttcttattgtgcctaaccaagatcaagcaaagtggcatgatttttctgatttaaaaaaagcccaaatgatagcaattggtgatcctgcaagtgttccagctggtcaatatgccgaagaaggcttaaaagctttaggcgcttggtcttatgtagaaaaacacgcaagctttggcacgaatgtaacagaagtccttgaatgggtagctaatgcaagtgcagaagctggcttagtttatgcgacagatgcagcaaccaattcaaaagtagcgattgttgcggccatgcctgaagctgttttgaaaaagccaattatctatccagttggtaaagttgccgcctctaagaaacaaaaatcagcagatgcttttttaaattttttacagagtcaacaatgcagaaaatattttganaatattggctttaagttaacaaagtag

SEQ ID NO: 190 - protein, 266 aa
MSKQKKAVFLLSLFSLVALIAACTNQPQKETVSTKKEEITLAAAASLESVMEKKIIPAFEKEHPDIQVTGTYDSSGKLQMQIEKGLKADVFFSASTKQMNALVAEKLINKKSVVPLLENQLVLIVPNQDQAKWHDFSDLKKAQMIAIGDPASVPAGQYAEEGLKALGAWSYVEKHASFGTNVTEVLEWVANASAEAGLVYATDAATNSKVAIVAAMPEAVLKKPIIYPVGKVAASKKQKSADAFLNFLQSQQCRKYFXNIGFKLTK

SEQ ID NO: 191 - DNA, 736 bp; double-stranded, linear
atgtacaaatcagccgcaaaaagaaacagtttcaacaaaaaaagaagaaataacccttgcggcagcagctagcttagaatcagtcatggagaagaaaattattccagcctttgaaaaagagcatccagatattcaggtaactggaacctatgatagttctggaaaattacagatgcaaattgaaaaaggcctaaaagccgatgtatttttctcagcttcgacaaaacaaatgaatgcattggttgcagaaaaactaattaataaaaaaagtgtcgttcctttattggaaaaccagctcgttcttattgtgcctaaccaagatcaagcaaagtggcatgatttttctgatttaaaaaaagcccaaatgatagcaattggtgatcctgcaagtgttccagctggtcaatatgccgaagaaggcttaaaagctttaggcgcttggtcttatgtagaaaaacacgcaagctttggcacgaatgtaacagaagtccttgaatgggtagctaatgcaagtgcagaagctggcttagtttatgcgacagatgcagcaaccaattcaaaagtagcgattgttgcggccatgcctgaagctgttttgaaaaagccaattatctatccagttggtaaagttgccgcctctaagaaacaaaaatcagcagatgcttttttaaattttttacagagtcaacaatgcagaaaatattttganaatattggctttaagttaacaaagtag

SEQ ID NO: 192 - protein, 244 aa
CTNQPQKETVSTKKEEITLAAAASLESVMEKKIIPAFEKEHPDIQVTGTYDSSGKLQMQIEKGLKADVFFSASTKQMNALVAEKLINKKSVVPLLENQLVLIVPNQDQAKWHDFSDLKKAQMIAIGDPASVPAGQYAEEGLKALGAWSYVEKHASFGTNVTEVLEWVANASAEAGLVYATDAATNSKVAIVAAMPEAVLKKPIIYPVGKVAASKKQKSADAFLNFLQSQQCRKYFXNIGFKLTK

SEQ ID NO: 193 - DNA, 501 bp; double-stranded, linear
taaagtaggagaagcgcaagcgaaaaaagtgaatcaatcggcagcgtatcaagtagtgatcccacaatgggtaccatgggtagcattatctttgacagtagcacttgctggattgattgcttacttagttcgtcgtggagagaagtggaaaaacgaaggggaagtgacataatgagangangaaatcttcngtttttattattgttggttctattaatttatattcctcaaacaacttatgcagaaaatagggagaccacagaagtcggaatcgggtttacaaaaacttcagacataccatcaaaaaaaaatccagttgtgaatgtattgccgcaaacaaccattcaatcgctatcaatcgttcgtagcagaacgcaaataaaaagattacctaaaactggtgacaatcgaataacttggctaagctggtttggcatattgtttttaataagtagtttttggctgtttctatttagacaattatgtagaaaaggagaataa

SEQ ID NO: 194 - protein, 109 aa
MRXXNLXFLLLLVLLIYIPQTTYAENRETTEVGIGFTKTSDIPSKKNPVVNVLPQTTIQSLSIVRSRTQIKRLPKTGDNRITWLSWFGILFLISSFWLFLFRQLCRKGE

SEQ ID NO: 195 - DNA, 146 bp; double-stranded, linear
agaaaatagggagaccacagaagtcggaatcgggtttacaaaaacttcagacataccatcaaaaaaaaatccagttgtgaatgtattgccgcaaacaaccattcaatcgctatcaatcgttcgtagcagaacgcaaataaaaagat

SEQ ID NO: 196 - protein, 48 aa
ENRETTEVGIGFTKTSDIPSKKNPVVNVLPQTTIQSLSIVRSRTQIKR

SEQ ID NO: 197 - DNA, 426 bp; double-stranded, linear
tagtcatggcaccataacaaggaggagagaagtgagatgaaaaaataccttttgcttagttgttttttaggtcttttcagcttctgtcattcagacactgcgtttggagaagcagcttatgaaaatagtggtgttgtctccttttatggaacgtatgaatatcccacagaagagtcgacaacagcgactagtaattcttccacaacgaccgaacccaccaagccagctgacggaggcgcttcatccgtcctttcttctggcgtatatggatcgcgacaaggaagattaccagcgacaggtaccaccaatcaagcaccatttatttatttgggaatcagccttatcactataggcatattatttattaaaaggagaagagaagatgaaaaaaacagtattagcagtagtagggattgtaggatttag

SEQ ID NO: 198 - protein, 129 aa
MKKYLLLSCFLGLFSFCHSDTAFGEAAYENSGVVSFYGTYEYPTEESTTATSNSSTTTEPTKPADGGASSVLSSGVYGSRQGRLPATGTTNQAPFIYLGISLITIGILFIKRRREDEKNSISSSRDCRI

SEQ ID NO: 199 - DNA, 183 bp; double-stranded, linear
tttggagaagcagcttatgaaaatagtggtgttgtctccttttatggaacgtatgaatatcccacagaagagtcgacaacagcgactagtaattcttccacaacgaccgaacccaccaagccagctgacggaggcgcttcatccgtcctttcttctggcgtatatggatcgcgacaaggaaga

SEQ ID NO: 200 - protein, 61 aa
FGEAAYENSGVVSFYGTYEYPTEESTTATSNSSTTTEPTKPADGGASSVLSSGVYGSRQGR

SEQ ID NO: 201 - DNA, 888 bp; double-stranded, linear
taaataaaaaattatttggaggaaattacaatgaaaaaaattattttatcaagcttgtttagtgcagtactagtattcggtggcggaagtataacagcattcgctgacgatttaggaccaacagatccagcaactccaccaattaccgaaccaactgattctagtgaacctacgaatcctactgagccggtggatcctgcagaaccgccagtaataccaactgatccaacagaaccaagcaagccaaccgagcctacaacaccgagtgagccagaaaagccaacagaaccaacaacgccaattgatcctggaacgccggttgaaccgactgaaccaagcgagccaacagaacctagtcaaccaaccgagcctacaacaccaagcgaaccagaaaaacctgttactccagaacaaccgaaagaaccaactcaaccagtgattccagaaaaaccagcagaaccagaaacaccaaaaactcctgaacagcccactaaaccaatagacgtagtcgttacacctagtggagaaattgataaaacgaatcaatcggcaggaacacaaccaagtattcctattgaaacaagcaacttagcggaggtaacacatgtaccaagtgaaactactccaattacaacagaagctggggaagaaattgtagcagtagataaaggtgttccgttaaccaaaacaccagaaggattaaaaccaattagcagctcgtataaggttttacctagcggaaacgttgaggtaaaagcaagtgatggaaaaatgaaagtattgccacatacaggagagaaattcacactccttttctctgtattgggaagcttctttgtattaatttcaggattctttttctttaaaaagaataagaaaaaagcttaa

SEQ ID NO: 202 - protein, 285 aa
MKKIILSSLFSAVLVFGGGSITAFADDLGPTDPATPPITEPTDSSEPTNPTEPVDPAEPPVIPTDPTEPSKPTEPTTPSEPEKPTEPTTPIDPGTPVEPTEPSEPTEPSQPTEPTTPSEPEKPVTPEQPKEPTQPVIPEKPAEPETPKTPEQPTKPIDVVVTPSGEIDKTNQSAGTQPSIPIETSNLAEVTHVPSETTPITTEAGEEIVAVDKGVPLTKTPEGLKPISSSYKVLPSGNVEVKASDGKMKVLPHTGEKFTLLFSVLGSFFVLISGFFFFKKNKKKA

SEQ ID NO: 203 - DNA, 662 bp; double-stranded, linear
aacagatccagcaactccaccaattaccgaaccaactgattctagtgaacctacgaatcctactgagccggtggatcctgcagaaccgccagtaataccaactgatccaacagaaccaagcaagccaaccgagcctacaacaccgagtgagccagaaaagccaacagaaccaacaacgccaattgatcctggaacgccggttgaaccgactgaaccaagcgagccaacagaacctagtcaaccaaccgagcctacaacaccaagcgaaccagaaaaacctgttactccagaacaaccgaaagaaccaactcaaccagtgattccagaaaaaccagcagaaccagaaacaccaaaaactcctgaacagcccactaaaccaatagacgtagtcgttacacctagtggagaaattgataaaacgaatcaatcggcaggaacacaaccaagtattcctattgaaacaagcaacttagcggaggtaacacatgtaccaagtgaaactactccaattacaacagaagctggggaagaaattgtagcagtagataaaggtgttccgttaaccaaaacaccagaaggattaaaaccaattagcagctcgtataaggttttacctagcggaaacgttgaggtaaaagcaagtgatggaaaaatgaaagtat

SEQ ID NO: 204 - protein, 225 aa
DDLGPTDPATPPITEPTDSSEPTNPTEPVDPAEPPVIPTDPTEPSKPTEPTTPSEPEKPTEPTTPIDPGTPVEPTEPSEPTEPSQPTEPTTPSEPEKPVTPEQPKEPTQPVIPEKPAEPETPKTPEQPTKPIDVVVTPSGEIDKTNQSAGTQPSIPIETSNLAEVTHVPSETTPITTEAGEEIVAVDKGVPLTKTPEGLKPISSSYKVLPSGNVEVKASDGKMKV

SEQ ID NO: 205 - DNA, 435 bp; double-stranded, linear
taacaaaaggttgttttgtctttcttgtgtaaaagggcaagaaaggctagcgagttaaaaggaggtttttcaatgaaaaaaaagcgttatttaatgattgtgtgtctactatcttctcctagtttttttataaatgttgaagcgtctgatggtggttctagttcggtggggattgaattttaccaaaatccgagaacacccgctcctaaagatcccccaccgaaaacagatgcgccagctgctgatcccaaggaaccagctggtcctccgcaaggagatcaacgaagtggtggttcgacacagaccaccacaactggctcaacgctccctcgtacagggagcaagagtcaggcaaatttgagcattctcngnttcgccttaatcggtttggcgggaatcgtacatagaaagaagggacgacatgaagcaaactaa

SEQ ID NO: 206 - protein, 120 aa
MKKKRYLMIVCLLSSPSFFINVEASDGGSSSVGIEFYQNPRTPAPKDPPPKTDAPAADPKEPAGPPQGDQRSGGSTQTTTTGSTLPRTGSKSQANLSILXFALIGLAGIVHRKKGRHEAN

SEQ ID NO: 207 - DNA, 184 bp; double-stranded, linear
agcgtctgatggtggttctagttcggtggggattgaattttaccaaaatccgagaacacccgctcctaaagatcccccaccgaaaacagatgcgccagctgctgatcccaaggaaccagctggtcctccgcaaggagatcaacgaagtggtggttcgacacagaccaccacaactggctcaacg

SEQ ID NO: 208 - protein, 60 aa
SDGGSSSVGIEFYQNPRTPAPKDPPPKTDAPAADPKEPAGPPQGDQRSGGSTQTTTTGST

SEQ ID NO: 209 - DNA, 366 bp; double-stranded, linear
taaatgaaaaaaaagcgttatttaataattgcgtgtttactattttcccctagtttttttataaatgttgaagcatctgagggtggttctagttcggtgggaattgaattttaccaaaatccggcaacacccgctcctaaagatgccccaccgaaaacagatgagccagctgcggatcccaaggaaccagctggtcctctgcaaggagatcaacgaagtggtggttcgacacagaccaccacagctggctcgcagctccctcgtacaggaagcaagagtcaggcaaacctgagcattcttggtcttgtcttgattggtcttgtcggaatggtccagagaaagaagggacgacatgaagcaaactaa

SEQ ID NO: 210 - protein, 120 aa
MKKKRYLIIACLLFSPSFFINVEASEGGSSSVGIEFYQNPATPAPKDAPPKTDEPAADPKEPAGPLQGDQRSGGSTQTTTAGSQLPRTGSKSQANLSILGLVLIGLVGMVQRKKGRHEAN

SEQ ID NO: 211 - DNA, 181 bp; double-stranded, linear
atctgagggtggttctagttcggtgggaattgaattttaccaaaatccggcaacacccgctcctaaagatgccccaccgaaaacagatgagccagctgcggatcccaaggaaccagctggtcctctgcaaggagatcaacgaagtggtggttcgacacagaccaccacagctggctcgcag

SEQ ID NO: 212 - protein, 60 aa
SEGGSSSVGIEFYQNPATPAPKDAPPKTDEPAADPKEPAGPLQGDQRSGGSTQTTTAGSQ

SEQ ID NO: 213 - DNA, 393 bp; double-stranded, linear
taatgtttattggctgggccagtcaatgttgaaaatggggaaggaggaattcagatgaaaatcataaaaaggtttagtttggtatgtttagggctattgatcattgggttgcnaacaaaaagcgntatggctgaagaaaataattatgaatcaaatggtcaagcgagcttctatggtacctacgtttatgagaatgaaaaagagtcaaatgacgtagcgtatacccaacaatcagaagaacagggaagaaacaatttagctgcttctggacaagcagttttacctaaaacaggcgagtctgaaaatccgctgtattccttgataggagttagtttgttggggatagtcatttatttaattaataaaatgaaacgagagaaggagtttatttaa

SEQ ID NO: 214 - protein, 112 aa
MKIIKRFSLVCLGLLIIGLXTKSXMAEENNYESNGQASFYGTYVYENEKESNDVAYTQQSEEQGRNNLAASGQAVLPKTGESENPLYSLIGVSLLGIVIYLINKMKREKEFI

SEQ ID NO: 215 - DNA, 143 bp; double-stranded, linear
aaataattatgaatcaaatggtcaagcgagcttctatggtacctacgtttatgagaatgaaaaagagtcaaatgacgtagcgtatacccaacaatcagaagaacagggaagaaacaatttagctgcttctggacaagcagttt

SEQ ID NO: 216 - protein, 49 aa
EENNYESNGQASFYGTYVYENEKESNDVAYTQQSEEQGRNNLAASGQAV

SEQ ID NO: 217 - DNA, 1983 bp; double-stranded, linear
tgaagaacgttctatttggttgacgattgcaggcctgctaatcattgggatggtagtcatttggctattttatcaaaaacaaaaaagaggagagagaaaatgaagcaattaaaaaaagtttggtacaccgttagtaccttgttactaattttgccacttttcacaagtgtattagggacaacaactgcatttgcagaagaaaatggggagagcgcacagctcgtgattcacaaaaagaaaatgacggatttaccagatccgcttattcaaaatagcgggaaagaaatgagcgagtttgataaatatcaaggactggcagatgtgacgtttagtatttataacgtgacgaacgaattttacgagcaacgagcggcaggcgcaagcgttgatgcagctaaacaagctgtccaaagtttaactcctgggaaacctgttgctcaaggaaccaccgatgcaaatgggaatgtcactgttcagttacctaaaaaacaaaatggtaaagatgcagtgtataccattaaagaagaaccaaaagagggtgtagttgctgctacgaatatggtggtggcgttcccagtttacgaaatgatcaagcaaacagatggttcctataaatatggaacagaagaattagcggttgttcatatttatcctaaaaatgtggtagccaatgatggtagtttacatgtgaaaaaagtaggaactgctgaaaatgaaggattaaatggcgcagaatttgttatttctaaaagcgaaggctcaccaggcacagtaaaatatatccaaggagtcaaagatggattatatacatggacaacggataaagaacaagcaaaacgctttattactgggaaaagttatgaaattggcgaaaatgatttcacagaagcagagaatggaacgggagaattaacagttaaaaatcttgaggttggttcgtatattttagaagaagtaaaagctccaaataatgcagaattaattgaaaatcaaacaaaaacaccatttacaattgaagcaaacaatcaaacacctgttgaaaaaacagtcaaaaatgatacctctaaagttgataaaacaacaccaagcttagatggtaaagatgtggcaattggcgaaaaaattaaatatcaaatttctgtaaatattccattggggattgcagacaaagaaggcgacgctaataaatacgtcaaattcaatttagttgataaacatgatgcagccttaacttttgataacgtgacttctggagagtatgcttatgcgttatatgatggggatacagtgattgctcctgaaaattatcaagtgactgaacaagcaaatggcttcactgtcgccgttaatccagcgtatattcctacgctaacaccaggcggcacactaaaattcgtttactttatgcatttaaatgaaaaagcagatcctacgaaaggctttaaaaatgaggcgaatgttgataacggtcataccgacgaccaaacaccaccaactgttgaagttgtgacaggtgggaaacgtttcattaaagtcgatggcgatgtgacagcgacacaagccttggcgggagcttcctttgtcgtccgtgatcaaaacagcgacacagcaaattatttgaaaatcgatgaaacaacgaaagcagcaacttgggtgaaaacaaaagctgaagcaactacttttacaacaacggctgatggattagttgatatcacagggcttaaatacggtacctattatttagaagaaactgtagctcctgatgattatgtcttgttaacaaatcggattgaatttgtggtcaatgaacaatcatatggcacaacagaaaacctagtttcaccagaaaaagtaccaaacaaacacaaaggtaccttaccttcaacaggtggcaaaggaatctacgtttacttaggaagtggcgcagtcttgctacttattgcaggagtctactttgctagacgtagaaaagaaaatgcttaa

SEQ ID NO: 218 - protein, 627 aa
MKQLKKVWYTVSTLLLILPLFTSVLGTTTAFAEENGESAQLVIHKKKMTDLPDPLIQNSGKEMSEFDKYQGLADVTFSIYNVTNEFYEQRAAGASVDAAKQAVQSLTPGKPVAQGTTDANGNVTVQLPKKQNGKDAVYTIKEEPKEGVVAATNMVVAFPVYEMIKQTDGSYKYGTEELAVVHIYPKNVVANDGSLHVKKVGTAENEGLNGAEFVISKSEGSPGTVKYIQGVKDGLYTWTTDKEQAKRFITGKSYEIGENDFTEAENGTGELTVKNLEVGSYILEEVKAPNNAELIENQTKTPFTIEANNQTPVEKTVKNDTSKVDKTTPSLDGKDVAIGEKIKYQISVNIPLGIADKEGDANKYVKFNLVDKHDAALTFDNVTSGEYAYALYDGDTVIAPENYQVTEQANGFTVAVNPAYIPTLTPGGTLKFVYFMHLNEKADPTKGFKNEANVDNGHTDDQTPPTVEVVTGGKRFIKVDGDVTATQALAGASFVVRDQNSDTANYLKIDETTKAATWVKTKAEATTFTTTADGLVDITGLKYGTYYLEETVAPDDYVLLTNRIEFVVNEQSYGTTENLVSPEKVPNKHKGTLPSTGGKGIYVYLGSGAVLLLIAGVYFARRRKENA

SEQ ID NO: 219 - DNA, 1687 bp; double-stranded, linear
agaagaaaatggggagagcgcacagctcgtgattcacaaaaagaaaatgacggatttaccagatccgcttattcaaaatagcgggaaagaaatgagcgagtttgataaatatcaaggactggcagatgtgacgtttagtatttataacgtgacgaacgaattttacgagcaacgagcggcaggcgcaagcgttgatgcagctaaacaagctgtccaaagtttaactcctgggaaacctgttgctcaaggaaccaccgatgcaaatgggaatgtcactgttcagttacctaaaaaacaaaatggtaaagatgcagtgtataccattaaagaagaaccaaaagagggtgtagttgctgctacgaatatggtggtggcgttcccagtttacgaaatgatcaagcaaacagatggttcctataaatatggaacagaagaattagcggttgttcatatttatcctaaaaatgtggtagccaatgatggtagtttacatgtgaaaaaagtaggaactgctgaaaatgaaggattaaatggcgcagaatttgttatttctaaaagcgaaggctcaccaggcacagtaaaatatatccaaggagtcaaagatggattatatacatggacaacggataaagaacaagcaaaacgctttattactgggaaaagttatgaaattggcgaaaatgatttcacagaagcagagaatggaacgggagaattaacagttaaaaatcttgaggttggttcgtatattttagaagaagtaaaagctccaaataatgcagaattaattgaaaatcaaacaaaaacaccatttacaattgaagcaaacaatcaaacacctgttgaaaaaacagtcaaaaatgatacctctaaagttgataaaacaacaccaagcttagatggtaaagatgtggcaattggcgaaaaaattaaatatcaaatttctgtaaatattccattggggattgcagacaaagaaggcgacgctaataaatacgtcaaattcaatttagttgataaacatgatgcagccttaacttttgataacgtgacttctggagagtatgcttatgcgttatatgatggggatacagtgattgctcctgaaaattatcaagtgactgaacaagcaaatggcttcactgtcgccgttaatccagcgtatattcctacgctaacaccaggcggcacactaaaattcgtttactttatgcatttaaatgaaaaagcagatcctacgaaaggctttaaaaatgaggcgaatgttgataacggtcataccgacgaccaaacaccaccaactgttgaagttgtgacaggtgggaaacgtttcattaaagtcgatggcgatgtgacagcgacacaagccttggcgggagcttcctttgtcgtccgtgatcaaaacagcgacacagcaaattatttgaaaatcgatgaaacaacgaaagcagcaacttgggtgaaaacaaaagctgaagcaactacttttacaacaacggctgatggattagttgatatcacagggcttaaatacggtacctattatttagaagaaactgtagctcctgatgattatgtcttgttaacaaatcggattgaatttgtggtcaatgaacaatcatatggcacaacagaaaacctagtttcaccagaaaaagtaccaaacaaacacaaaggtaccttacct

SEQ ID NO: 220 - protein, 560 aa
EENGESAQLVIHKKKMTDLPDPLIQNSGKEMSEFDKYQGLADVTFSIYNVTNEFYEQRAAGASVDAAKQAVQSLTPGKPVAQGTTDANGNVTVQLPKKQNGKDAVYTIKEEPKEGVVAATNMVVAFPVYEMIKQTDGSYKYGTEELAVVHIYPKNVVANDGSLHVKKVGTAENEGLNGAEFVISKSEGSPGTVKYIQGVKDGLYTWTTDKEQAKRFITGKSYEIGENDFTEAENGTGELTVKNLEVGSYILEEVKAPNNAELIENQTKTPFTIEANNQTPVEKTVKNDTSKVDKTTPSLDGKDVAIGEKIKYQISVNIPLGIADKEGDANKYVKFNLVDKHDAALTFDNVTSGEYAYALYDGDTVIAPENYQVTEQANGFTVAVNPAYIPTLTPGGTLKFVYFMHLNEKADPTKGFKNEANVDNGHTDDQTPPTVEVVTGGKRFIKVDGDVTATQALAGASFVVRDQNSDTANYLKIDETTKAATWVKTKAEATTFTTTADGLVDITGLKYGTYYLEETVAPDDYVLLTNRIEFVVNEQSYGTTENLVSPEKVPNKHKGT

SEQ ID NO: 221 - DNA, 867 bp; double-stranded, linear
tagattggaagaatgaaaatgaaaaaaatgattattattgccttattcagtacaagccttttagcagggggaagcagtgtttctgcttatgcgcaagaatcagaaggaaatcttggtgaaacaacagggagtgttttaccagatgaaccgaatgtaccaactgacccaataacgccaagtgagccagagcaaccaacagagccaagtacaccagagcaaccatcggaaccgtcaacaccaaccgaacctagtgagccttcaaaaccgacggatccttcgttaccagacgaaccgagcgtaccaacagagccaacaacgccaagtaagccagagcaaccaacagagccaacaacgccaagtgtaccagagcaaccaacagagccaagtgtaccagaaaaaccagtagaaccaaataaaccaaccgagccagaaaagcctgtgccagttgttcctgaaaaaccagttgtaccacaacaaccagagcaaccaacagatgtggtggtaaagccaaatggagaaattgcaacaggagaatctacacaacagccaactgttccaattgaaacgaataacctttcagaagtaacacatgtcccaactgtgacgacaccgattgaaacagcaagcggagaagcaattgtcgcagtggataagggcgttcctttaacacaaacggctgatggattaaaaccgattaaaagtgaatataaagtattaccaagtggcaatgtacaagtgaaaagtgctgacggaaaaatgaaagtacttccttacactggtgaaaaaatgggcataattgggtcaatcgctggtgtatgtttgactgttttatcaggaatcttaatttataaaaaacgtaaagtgtag

SEQ ID NO: 222 - protein, 282 aa
MKKMIIIALFSTSLLAGGSSVSAYAQESEGNLGETTGSVLPDEPNVPTDPITPSEPEQPTEPSTPEQPSEPSTPTEPSEPSKPTDPSLPDEPSVPTEPTTPSKPEQPTEPTTPSVPEQPTEPSVPEKPVEPNKPTEPEKPVPVVPEKPVVPQQPEQPTDVVVKPNGEIATGESTQQPTVPIETNNLSEVTHVPTVTTPIETASGEAIVAVDKGVPLTQTADGLKPIKSEYKVLPSGNVQVKSADGKMKVLPYTGEKMGIIGSIAGVCLTVLSGILIYKKRKV

SEQ ID NO: 223 - DNA, 665 bp; double-stranded, linear
agaaggaaatcttggtgaaacaacagggagtgttttaccagatgaaccgaatgtaccaactgacccaataacgccaagtgagccagagcaaccaacagagccaagtacaccagagcaaccatcggaaccgtcaacaccaaccgaacctagtgagccttcaaaaccgacggatccttcgttaccagacgaaccgagcgtaccaacagagccaacaacgccaagtaagccagagcaaccaacagagccaacaacgccaagtgtaccagagcaaccaacagagccaagtgtaccagaaaaaccagtagaaccaaataaaccaaccgagccagaaaagcctgtgccagttgttcctgaaaaaccagttgtaccacaacaaccagagcaaccaacagatgtggtggtaaagccaaatggagaaattgcaacaggagaatctacacaacagccaactgttccaattgaaacgaataacctttcagaagtaacacatgtcccaactgtgacgacaccgattgaaacagcaagcggagaagcaattgtcgcagtggataagggcgttcctttaacacaaacggctgatggattaaaaccgattaaaagtgaatataaagtattaccaagtggcaatgtacaagtgaaaagtgctgacggaaaaatgaaagtac

SEQ ID NO: 224 - protein, 221 aa
EGNLGETTGSVLPDEPNVPTDPITPSEPEQPTEPSTPEQPSEPSTPTEPSEPSKPTDPSLPDEPSVPTEPTTPSKPEQPTEPTTPSVPEQPTEPSVPEKPVEPNKPTEPEKPVPVVPEKPVVPQQPEQPTDVVVKPNGEIATGESTQQPTVPIETNNLSEVTHVPTVTTPIETASGEAIVAVDKGVPLTQTADGLKPIKSEYKVLPSGNVQVKSADGKMKV

SEQ ID NO: 225 - DNA, 426 bp; double-stranded, linear
tgaaaaatagacaaggagcacgcgatgatgacaatgaaaagtaaagggtcacttctggtgacgttgggaatacttttaaccgttggcattgcgagtctaattgtttcttctgagagttttgcagaagaagtagggcaaacgaatatcggtgtaacgttctatggaggaaaagagccactaaaaacggaaggtgtcattaagccaatagagcaaccagtcactgataaagataaaaaaacgtcacaacaacaagacaaagtgagcagaaaaaccactgctaaaacgaatccgactaatgcacagacgtcattaccaaggacaggtgaacgaaatagcacgtggctttacagccttggtattgcctgtttactcgtagtactaacaagtttctattatttgaataaaaaaaggaaaaaggaaaaataa

SEQ ID NO: 226 - protein, 133 aa
MMTMKSKGSLLVTLGILLTVGIASLIVSSESFAEEVGQTNIGVTFYGGKEPLKTEGVIKPIEQPVTDKDKKTSQQQDKVSRKTTAKTNPTNAQTSLPRTGERNSTWLYSLGIACLLVVLTSFYYLNKKRKKEK

SEQ ID NO: 227 - DNA, 188 bp; double-stranded, linear
agaagaagtagggcaaacgaatatcggtgtaacgttctatggaggaaaagagccactaaaaacggaaggtgtcattaagccaatagagcaaccagtcactgataaagataaaaaaacgtcacaacaacaagacaaagtgagcagaaaaaccactgctaaaacgaatccgactaatgcacagacgtcat

SEQ ID NO: 228 - protein, 62 aa
EEVGQTNIGVTFYGGKEPLKTEGVIKPIEQPVTDKDKKTSQQQDKVSRKTTAKTNPTNAQTS

SEQ ID NO: 229 - DNA, 834 bp; double-stranded, linear
taatggaacgaccgacagaagaagattttgaacttacaaattaaaattaaaatggaggaaataatgatgaaaaaaattctttttgctagtttatttagtgccacactactatttgggggaagtgaaatttctgcttttgcacaagaaattatccctgatgatactacgacaccgcccattgaagtaccaacagaaccaagtacaccagaaaagccaacagatccaacaccgccaattgagccacctgtagaccctgtagagccacctattacaccaacggagccaacagaaccgacagagccgacaacaccaacagaacctacaactcctacagagccaagtgaaccagaacaaccaacggagccaagtaaaccagtagaacctgaaaaaccagttacaccaagcaaaccagcagaacccgaaaaaactgtgacaccaactaaaccaacagaatctgaaaaaccagtacaaccagcagaaccaagcaagccaatcgacgttgttgtaacgccaacaggggaattaaatcacgctggaaatggtacacaacagccaacagtccctattgaaacaagtaatttggcagaaatcacgcacgtgcctagtgtaacaacacctattacaactacagacggagaaaacattgtagctgtagaaaaaggtgttccacttacacaaacagcagaagggttaaaacctattcaatcnagttacaaagtattgcctagcggaaatgtagaagtaaaaggtaaggacggtaaaatgaaggttttaccatacacaggtgaagaaatgaatatctttttatctgccgtagcggtatcttgtctgtag

SEQ ID NO: 230 - protein, 256 aa
MMKKILFASLFSATLLFGGSEISAFAQEIIPDDTTTPPIEVPTEPSTPEKPTDPTPPIEPPVDPVEPPITPTEPTEPTEPTTPTEPTTPTEPSEPEQPTEPSKPVEPEKPVTPSKPAEPEKTVTPTKPTESEKPVQPAEPSKPIDVVVTPTGELNHAGNGTQQPTVPIETSNLAEITHVPSVTTPITTTDGENIVAVEKGVPLTQTAEGLKPIQSSYKVLPSGNVEVKGKDGKMKVLPYTGEEMNIFLSAVAVSCL

SEQ ID NO: 231 - DNA, 649 bp; double-stranded, linear
gaaatttctgcttttgcacaagaaattatccctgatgatactacgacaccgcccattgaagtaccaacagaaccaagtacaccagaaaagccaacagatccaacaccgccaattgagccacctgtagaccctgtagagccacctattacaccaacggagccaacagaaccgacagagccgacaacaccaacagaacctacaactcctacagagccaagtgaaccagaacaaccaacggagccaagtaaaccagtagaacctgaaaaaccagttacaccaagcaaaccagcagaacccgaaaaaactgtgacaccaactaaaccaacagaatctgaaaaaccagtacaaccagcagaaccaagcaagccaatcgacgttgttgtaacgccaacaggggaattaaatcacgctggaaatggtacacaacagccaacagtccctattgaaacaagtaatttggcagaaatcacgcacgtgcctagtgtaacaacacctattacaactacagacggagaaaacattgtagctgtagaaaaaggtgttccacttacacaaacagcagaagggttaaaacctattcaatcnagttacaaagtattgcctagcggaaatgtagaagtaaaaggtaaggacggtaaaatgaaggttt

SEQ ID NO: 232 - protein, 210 aa
QEIIPDDTTTPPIEVPTEPSTPEKPTDPTPPIEPPVDPVEPPITPTEPTEPTEPTTPTEPTTPTEPSEPEQPTEPSKPVEPEKPVTPSKPAEPEKTVTPTKPTESEKPVQPAEPSKPIDVVVTPTGELNHAGNGTQQPTVPIETSNLAEITHVPSVTTPITTTDGENIVAVEKGVPLTQTAEGLKPIQSSYKVLPSGNVEVKGKDGKMKV

SEQ ID NO: 233 - DNA, 3924 bp; double-stranded, linear
tgattcttgaagcaacaaatgaaagcaaaaaaacaatataagacatataaagctaagaatcactgggtaactgtccctattctttttctaagtgtgttaggagccgtaggattagctactgataatgtacaagccgcggaattagatacgcaaccagaaacaacgacggttcaacccaataaccccgacctgcagtcagaaaaggaaacacctaaaacggcagtatctgaagaagcaacagtacaaaaagacactacttctcaaccgaccaaagtagaagaagtagcgccagaaaataaaggtactgaacaaagttcagctaccccaaatgataccacaaacgcgcaacaaccaacagtaggagctgaaaaatcagcacaagaacaaccagtagtaagccctgaaacaaccaatgaacctctagggcagccaacagaagttgcaccagctgaaaatgaagtgaataaatcaacgtccattcctaaagaatttgaaacaccagacgttgataaagcagttgatgaagtaaaaaaagatccaaacattaccgttgttgaaaaaccagcagaagacttaggcaacgtttcttctaaagatttagctgcaaaagaaaaagaagtagaccaactacaaaaagaacaagcgaaaaagattgcccaacaagcagctgaattaaaagccaaaaatgaaaaaattgccaaagaaaatgcagaaattgcggcaaaaaacaaagcngaaaaagagcgntanganaaagaagtcgcngaatacaacaagcataagaacgaaaacagctatgtcaatgaagcgattagtaaaaacctagtgttcgatcaatctgtcgtgacgaaagacactaaaatttcgtcgattaaaggcggaaaatttatcaaagcaactgattttaataaagtaaatgcaggggattcaaaagatatctttacaaaattacggaaagatatgggngggaaagntactggcaacttccagaattcctttgtaaaagaggcaaatcttgggtctaatggtgggtatgcggttcttttagaaaaaaataaaccagtgacagtgacctatacaggactaaacgctagttatttaggacgtaaaattacaaaagcagaatttgtttatgaactacaatcctcaccaagccaaagtggaacgttaaatgcagtattttcaaacgatccgattatcacngcttttattggtacaaacagagtcaatggtaaggatgttaaaacacgcttaacgattaagttctttgatgcgtcaggtaaagaagtactaccagataaagatagtccatttgcgtatgcgctgtcttctttaaattcaagtttaacgaataaaggtggccatgcggaatttgtttctgattttggggcnaacaatgcgttcaaatacattaatggntcntatgtgaaaaaacaagcggatggaaaattttactcaccggaagatattgactatggcacaggaccttctggattgaaaaatagtgattgggacgctgtaggtcacaagaatgcctactttggttcaggtgtaggtctagcnaatggncgtatttccttttcttttggtatgacaacaaaaggaaaaagtaatgtgcctgtatctagtgcgcaatggtttgcctttagnactaacttaaatgcgcaatcagtgaagcctattttcaattatgggaatccaaaagaaccagaaaaagcaacgattgaattcaatngatacaaagccaatgtcgttcctgtncttgtgccnaataaagaagtcactgatggncagaaaaatntcaatgatttaaatgtgaancgtggcgattctttacaatacattgtgacaggggatacgacagaacttgccaaagtagatccaaaaacagtaacnaaacaagggattcgagatacntttgatgcagaaaaagtgacgattgatttatccaaagtgaaagtttatcaagcagacgcaagtctnaacganaaagactnaaaagctgttgctgcagcnattaattcaggaanagctaaagacgtgactgcttcttatganctcaatttagatcaaaacaccgtcacagcaatgatgaaaaccaacgcngacggntcngttgttttagcaatggggtataaatatttacttgtcttgccgtttgtagtgaaaaatgtagaaggcgattttgaaaatacagctgttcagctgacaaangatggngaaacggtaacaaatacagtgattaaccatgtgccaggtagtaatccttccaaagatgtaaaagcagataaaaacggtacagttggcagtgtttctctacatgataaagatattccgttacaaacaaaaatttattatgaagtgaaatcttccgaacgtccagcnaactatggcggaatnacngaagaatggggcatgaatgatgtcttggacacgacccatgatcgtttcacaggnaaatggcacgctattacnaantatgaccttaaagtagggganaaaacgttaaaagcaggaacagatatttctgcctacattcttttagaaaacaaagacaataaagacttgacgtttacnatgaatcaagcattattggcngcnttaaatgaaggaagcaataaagtaggcaaacaagcttggtctgtgtatctggaagtcgaacggatnaaaacaggtgacgtagaaaacacgcaaacagaaaactacaacaaagagcttgtncgttctaatacngtggtgacgcatacncctgatgatccaaaaccaaccaaagccgttcataacaagaaaggggaaganattaancatggaaaagtngctcgtggtgatgttctttcttatgaaatgacntgggacttaaaagggtacgataaagactttgcctttgatacagtcgatcttgcgacaggcgtttctttcttcgatgattacgatgaaacgaangtgacaccaatcaaagacttacttcgtgtcaaagattctaaaggggnagacattacgaaccagttcacgatctcntgggacgatgccaaaggcacggtgacnatntctgccaaagacccacaagcctttattctagcgnatggtgggcaagaattgcgtgtaacnctccctacaaaagtcaaagccgatgtttctggngatgtttataattcagcggaacaaaatacatttggncaacgaattaaaaccaatacngttgtcaaccatattccaaaagtgaancctaaaaaagacgtggttattaaagtnggtgacaaacaaagtcaaaatggngccacaatcaaattaggggagaanttcttctatgaatttacaagtagtgacattcctgcagaatacgctggngttgtggaagaatggtcgattagcgataaactagacgtcaaacatgacaaatttagtggccaatggtctgtgtttgccaattctaattttgttttagcagacggaaccaaagtgaataaaggggacgacatttcgaaactattcacgatgacctttgaacaaggggtagtgaaaatcacggccagtcaagcctttttngatgcgatgaatctaaaagaaaacaaaaacgttgcacactcatggaaagcgttcattggtgtagaacgaattgcggcaggagacgtttacaacacaatcgaagaatctttcaacaatgagaagattaaaacnaatacggtagtgacncatacgccagaaaaaccacaaacnccaccagaaaaaacagtgattgtaccaccaacaccaaaaacaccgcaagcaccagtagagccattagtggtagaaaaggcaagtgtngtgccagaattgccgcaaacaggcgaaaaacaaaatgtcttattaacggtagctggtagtttagccgcaatgcttggcttagcaggcttaggctttaaacgtagaaaagaaacaaaataa

SEQ ID NO: 234 - protein, 1301 aa
MKAKKQYKTYKAKNHWVTVPILFLSVLGAVGLATDNVQAAELDTQPETTTVQPNNPDLQSEKETPKTAVSEEATVQKDTTSQPTKVEEVAPENKGTEQSSATPNDTTNAQQPTVGAEKSAQEQPVVSPETTNEPLGQPTEVAPAENEVNKSTSIPKEFETPDVDKAVDEVKKDPNITVVEKPAEDLGNVSSKDLAAKEKEVDQLQKEQAKKIAQQAAELKAKNEKIAKENAEIAAKNKAEKERXXKEVAEYNKHKNENSYVNEAISKNLVFDQSVVTKDTKISSIKGGKFIKATDFNKVNAGDSKDIFTKLRKDMGGKXTGNFQNSFVKEANLGSNGGYAVLLEKNKPVTVTYTGLNASYLGRKITKAEFVYELQSSPSQSGTLNAVFSNDPIITAFIGTNRVNGKDVKTRLTIKFFDASGKEVLPDKDSPFAYALSSLNSSLTNKGGHAEFVSDFGANNAFKYINGSYVKKQADGKFYSPEDIDYGTGPSGLKNSDWDAVGHKNAYFGSGVGLANGRISFSFGMTTKGKSNVPVSSAQWFAFXTNLNAQSVKPIFNYGNPKEPEKATIEFNXYKANVVPVLVPNKEVTDGQKNXNDLNVXRGDSLQYIVTGDTTELAKVDPKTVTKQGIRDTFDAEKVTIDLSKVKVYQADASLNXKDXKAVAAAINSGXAKDVTASYXLNLDQNTVTAMMKTNADGSVVLAMGYKYLLVLPFVVKNVEGDFENTAVQLTXDGETVTNTVINHVPGSNPSKDVKADKNGTVGSVSLHDKDIPLQTKIYYEVKSSERPANYGGXTEEWGMNDVLDTTHDRFTGKWHAITXYDLKVGXKTLKAGTDISAYILLENKDNKDLTFTMNQALLAALNEGSNKVGKQAWSVYLEVERXKTGDVENTQTENYNKELVRSNTVVTHTPDDPKPTKAVHNKKGEXIXHGKVARGDVLSYEMTWDLKGYDKDFAFDTVDLATGVSFFDDYDETXVTPIKDLLRVKDSKGXDITNQFTISWDDAKGTVTXSAKDPQAFILAXGGQELRVTLPTKVKADVSGDVYNSAEQNTFGQRIKTNTVVNHIPKVXPKKDVVIKVGDKQSQNGATIKLGEXFFYEFTSSDIPAEYAGVVEEWSISDKLDVKHDKFSGQWSVFANSNFVLADGTKVNKGDDISKLFTMTFEQGVVKITASQAFXDAMNLKENKNVAHSWKAFIGVERIAAGDVYNTIEESFNNEKIKTNTVVTHTPEKPQTPPEKTVIVPPTPKTPQAPVEPLVVEKASVVPELPQTGEKQNVLLTVAGSLAAMLGLAGLGFKRRKETK

SEQ ID NO: 235 - DNA, 3802 bp; double-stranded, linear
tgattcttgaagcaacaaatgaaagcaaaaaaacaatataagacatataaagctaagaatcactgggtaactgtccctattctttttctaagtgtgttaggagccgtaggattagctactgataatgtacaagccgcggaattagatacgcaaccagaaacaacgacggttcaacccaataaccccgacctgcagtcagaaaaggaaacacctaaaacggcagtatctgaagaagcaacagtacaaaaagacactacttctcaaccgaccaaagtagaagaagtagcgccagaaaataaaggtactgaacaaagttcagctaccccaaatgataccacaaacgcgcaacaaccaacagtaggagctgaaaaatcagcacaagaacaaccagtagtaagccctgaaacaaccaatgaacctctagggcagccaacagaagttgcaccagctgaaaatgaagtgaataaatcaacgtccattcctaaagaatttgaaacaccagacgttgataaagcagttgatgaagtaaaaaaagatccaaacattaccgttgttgaaaaaccagcagaagacttaggcaacgtttcttctaaagatttagctgcaaaagaaaaagaagtagaccaactacaaaaagaacaagcgaaaaagattgcccaacaagcagctgaattaaaagccaaaaatgaaaaaattgccaaagaaaatgcagaaattgcggcaaaaaacaaagcngaaaaagagcgntanganaaagaagtcgcngaatacaacaagcataagaacgaaaacagctatgtcaatgaagcgattagtaaaaacctagtgttcgatcaatctgtcgtgacgaaagacactaaaatttcgtcgattaaaggcggaaaatttatcaaagcaactgattttaataaagtaaatgcaggggattcaaaagatatctttacaaaattacggaaagatatgggngggaaagntactggcaacttccagaattcctttgtaaaagaggcaaatcttgggtctaatggtgggtatgcggttcttttagaaaaaaataaaccagtgacagtgacctatacaggactaaacgctagttatttaggacgtaaaattacaaaagcagaatttgtttatgaactacaatcctcaccaagccaaagtggaacgttaaatgcagtattttcaaacgatccgattatcacngcttttattggtacaaacagagtcaatggtaaggatgttaaaacacgcttaacgattaagttctttgatgcgtcaggtaaagaagtactaccagataaagatagtccatttgcgtatgcgctgtcttctttaaattcaagtttaacgaataaaggtggccatgcggaatttgtttctgattttggggcnaacaatgcgttcaaatacattaatggntcntatgtgaaaaaacaagcggatggaaaattttactcaccggaagatattgactatggcacaggaccttctggattgaaaaatagtgattgggacgctgtaggtcacaagaatgcctactttggttcaggtgtaggtctagcnaatggncgtatttccttttcttttggtatgacaacaaaaggaaaaagtaatgtgcctgtatctagtgcgcaatggtttgcctttagnactaacttaaatgcgcaatcagtgaagcctattttcaattatgggaatccaaaagaaccagaaaaagcaacgattgaattcaatngatacaaagccaatgtcgttcctgtncttgtgccnaataaagaagtcactgatggncagaaaaatntcaatgatttaaatgtgaancgtggcgattctttacaatacattgtgacaggggatacgacagaacttgccaaagtagatccaaaaacagtaacnaaacaagggattcgagatacntttgatgcagaaaaagtgacgattgatttatccaaagtgaaagtttatcaagcagacgcaagtctnaacganaaagactnaaaagctgttgctgcagcnattaattcaggaanagctaaagacgtgactgcttcttatganctcaatttagatcaaaacaccgtcacagcaatgatgaaaaccaacgcngacggntcngttgttttagcaatggggtataaatatttacttgtcttgccgtttgtagtgaaaaatgtagaaggcgattttgaaaatacagctgttcagctgacaaangatggngaaacggtaacaaatacagtgattaaccatgtgccaggtagtaatccttccaaagatgtaaaagcagataaaaacggtacagttggcagtgtttctctacatgataaagatattccgttacaaacaaaaatttattatgaagtgaaatcttccgaacgtccagcnaactatggcggaatnacngaagaatggggcatgaatgatgtcttggacacgacccatgatcgtttcacaggnaaatggcacgctattacnaantatgaccttaaagtagggganaaaacgttaaaagcaggaacagatatttctgcctacattcttttagaaaacaaagacaataaagacttgacgtttacnatgaatcaagcattattggcngcnttaaatgaaggaagcaataaagtaggcaaacaagcttggtctgtgtatctggaagtcgaacggatnaaaacaggtgacgtagaaaacacgcaaacagaaaactacaacaaagagcttgtncgttctaatacngtggtgacgcatacncctgatgatccaaaaccaaccaaagccgttcataacaagaaaggggaaganattaancatggaaaagtngctcgtggtgatgttctttcttatgaaatgacntgggacttaaaagggtacgataaagactttgcctttgatacagtcgatcttgcgacaggcgtttctttcttcgatgattacgatgaaacgaangtgacaccaatcaaagacttacttcgtgtcaaagattctaaaggggnagacattacgaaccagttcacgatctcntgggacgatgccaaaggcacggtgacnatntctgccaaagacccacaagcctttattctagcgnatggtgggcaagaattgcgtgtaacnctccctacaaaagtcaaagccgatgtttctggngatgtttataattcagcggaacaaaatacatttggncaacgaattaaaaccaatacngttgtcaaccatattccaaaagtgaancctaaaaaagacgtggttattaaagtnggtgacaaacaaagtcaaaatggngccacaatcaaattaggggagaanttcttctatgaatttacaagtagtgacattcctgcagaatacgctggngttgtggaagaatggtcgattagcgataaactagacgtcaaacatgacaaatttagtggccaatggtctgtgtttgccaattctaattttgttttagcagacggaaccaaagtgaataaaggggacgacatttcgaaactattcacgatgacctttgaacaaggggtagtgaaaatcacggccagtcaagcctttttngatgcgatgaatctaaaagaaaacaaaaacgttgcacactcatggaaagcgttcattggtgtagaacgaattgcggcaggagacgtttacaacacaatcgaagaatctttcaacaatgagaagattaaaacnaatacggtagtgacncatacgccagaaaaaccacaaacnccaccagaaaaaacagtgattgtaccaccaacaccaaaaacaccgcaagcaccagtagagccattagtggtagaaaaggcaagtg

SEQ ID NO: 236 - protein, 1223 aa
AELDTQPETTTVQPNNPDLQSEKETPKTAVSEEATVQKDTTSQPTKVEEVAPENKGTEQSSATPNDTTNAQQPTVGAEKSAQEQPVVSPETTNEPLGQPTEVAPAENEVNKSTSIPKEFETPDVDKAVDEVKKDPNITVVEKPAEDLGNVSSKDLAAKEKEVDQLQKEQAKKIAQQAAELKAKNEKIAKENAEIAAKNKAEKERXXKEVAEYNKHKNENSYVNEAISKNLVFDQSVVTKDTKISSIKGGKFIKATDFNKVNAGDSKDIFTKLRKDMGGKXTGNFQNSFVKEANLGSNGGYAVLLEKNKPVTVTYTGLNASYLGRKITKAEFVYELQSSPSQSGTLNAVFSNDPIITAFIGTNRVNGKDVKTRLTIKFFDASGKEVLPDKDSPFAYALSSLNSSLTNKGGHAEFVSDFGANNAFKYINGSYVKKQADGKFYSPEDIDYGTGPSGLKNSDWDAVGHKNAYFGSGVGLANGRISFSFGMTTKGKSNVPVSSAQWFAFXTNLNAQSVKPIFNYGNPKEPEKATIEFNXYKANVVPVLVPNKEVTDGQKNXNDLNVXRGDSLQYIVTGDTTELAKVDPKTVTKQGIRDTFDAEKVTIDLSKVKVYQADASLNXKDXKAVAAAINSGXAKDVTASYXLNLDQNTVTAMMKTNADGSVVLAMGYKYLLVLPFVVKNVEGDFENTAVQLTXDGETVTNTVINHVPGSNPSKDVKADKNGTVGSVSLHDKDIPLQTKIYYEVKSSERPANYGGXTEEWGMNDVLDTTHDRFTGKWHAITXYDLKVGXKTLKAGTDISAYILLENKDNKDLTFTMNQALLAALNEGSNKVGKQAWSVYLEVERXKTGDVENTQTENYNKELVRSNTVVTHTPDDPKPTKAVHNKKGEXIXHGKVARGDVLSYEMTWDLKGYDKDFAFDTVDLATGVSFFDDYDETXVTPIKDLLRVKDSKGXDITNQFTISWDDAKGTVTXSAKDPQAFILAXGGQELRVTLPTKVKADVSGDVYNSAEQNTFGQRIKTNTVVNHIPKVXPKKDVVIKVGDKQSQNGATIKLGEXFFYEFTSSDIPAEYAGVVEEWSISDKLDVKHDKFSGQWSVFANSNFVLADGTKVNKGDDISKLFTMTFEQGVVKITASQAFXDAMNLKENKNVAHSWKAFIGVERIAAGDVYNTIEESFNNEKIKTNTVVTHTPEKPQTPPEKTVIVPPTPKTPQAPVEPLVVEKASV

SEQ ID NO: 237 - DNA, 3924 bp; double-stranded, linear; identical to SEQ ID NO: 233

SEQ ID NO: 238 - protein, 1301 aa; identical to SEQ ID NO: 234

SEQ ID NO: 239 - DNA, 1819 bp; double-stranded, linear
ggaattagatacgcaaccagaaacaacgacggttcaacccaataaccccgacctgcagtcagaaaaggaaacacctaaaacggcagtatctgaagaagcaacagtacaaaaagacactacttctcaaccgaccaaagtagaagaagtagcgccagaaaataaaggtactgaacaaagttcagctaccccaaatgataccacaaacgcgcaacaaccaacagtaggagctgaaaaatcagcacaagaacaaccagtagtaagccctgaaacaaccaatgaacctctagggcagccaacagaagttgcaccagctgaaaatgaagtgaataaatcaacgtccattcctaaagaatttgaaacaccagacgttgataaagcagttgatgaagtaaaaaaagatccaaacattaccgttgttgaaaaaccagcagaagacttaggcaacgtttcttctaaagatttagctgcaaaagaaaaagaagtagaccaactacaaaaagaacaagcgaaaaagattgcccaacaagcagctgaattaaaagccaaaaatgaaaaaattgccaaagaaaatgcagaaattgcggcaaaaaacaaagcngaaaaagagcgntanganaaagaagtcgcngaatacaacaagcataagaacgaaaacagctatgtcaatgaagcgattagtaaaaacctagtgttcgatcaatctgtcgtgacgaaagacactaaaatttcgtcgattaaaggcggaaaatttatcaaagcaactgattttaataaagtaaatgcaggggattcaaaagatatctttacaaaattacggaaagatatgggngggaaagntactggcaacttccagaattcctttgtaaaagaggcaaatcttgggtctaatggtgggtatgcggttcttttagaaaaaaataaaccagtgacagtgacctatacaggactaaacgctagttatttaggacgtaaaattacaaaagcagaatttgtttatgaactacaatcctcaccaagccaaagtggaacgttaaatgcagtattttcaaacgatccgattatcacngcttttattggtacaaacagagtcaatggtaaggatgttaaaacacgcttaacgattaagttctttgatgcgtcaggtaaagaagtactaccagataaagatagtccatttgcgtatgcgctgtcttctttaaattcaagtttaacgaataaaggtggccatgcggaatttgtttctgattttggggcnaacaatgcgttcaaatacattaatggntcntatgtgaaaaaacaagcggatggaaaattttactcaccggaagatattgactatggcacaggaccttctggattgaaaaatagtgattgggacgctgtaggtcacaagaatgcctactttggttcaggtgtaggtctagcnaatggncgtatttccttttcttttggtatgacaacaaaaggaaaaagtaatgtgcctgtatctagtgcgcaatggtttgcctttagnactaacttaaatgcgcaatcagtgaagcctattttcaattatgggaatccaaaagaaccagaaaaagcaacgattgaattcaatngatacaaagccaatgtcgttcctgtncttgtgccnaataaagaagtcactgatggncagaaaaatntcaatgatttaaatgtgaancgtggcgattctttacaatacattgtgacaggggatacgacagaacttgccaaagtagatccaaaaacagtaacnaaacaagggattcgagatacntttgatgcagaaaaagtgacgattgatttatccaaagtg

SEQ ID NO: 240 - protein, 606 aa
ELDTQPETTTVQPNNPDLQSEKETPKTAVSEEATVQKDTTSQPTKVEEVAPENKGTEQSSATPNDTTNAQQPTVGAEKSAQEQPVVSPETTNEPLGQPTEVAPAENEVNKSTSIPKEFETPDVDKAVDEVKKDPNITVVEKPAEDLGNVSSKDLAAKEKEVDQLQKEQAKKIAQQAAELKAKNEKIAKENAEIAAKNKAEKERXXKEVAEYNKHKNENSYVNEAISKNLVFDQSVVTKDTKISSIKGGKFIKATDFNKVNAGDSKDIFTKLRKDMGGKXTGNFQNSFVKEANLGSNGGYAVLLEKNKPVTVTYTGLNASYLGRKITKAEFVYELQSSPSQSGTLNAVFSNDPIITAFIGTNRVNGKDVKTRLTIKFFDASGKEVLPDKDSPFAYALSSLNSSLTNKGGHAEFVSDFGANNAFKYINGSYVKKQADGKFYSPEDIDYGTGPSGLKNSDWDAVGHKNAYFGSGVGLANGRISFSFGMTTKGKSNVPVSSAQWFAFXTNLNAQSVKPIFNYGNPKEPEKATIEFNXYKANVVPVLVPNKEVTDGQKNXNDLNVXRGDSLQYIVTGDTTELAKVDPKTVTKQGIRDTFDAEKVTIDLSKV

SEQ ID NO: 241 - DNA, 3924 bp; double-stranded, linear; identical to SEQ ID NO: 233

SEQ ID NO: 242 - protein, 1301 aa; identical to SEQ ID NO: 234

SEQ ID NO: 243 - DNA, 1993 bp; double-stranded, linear
agtgacgattgatttatccaaagtgaaagtttatcaagcagacgcaagtctnaacganaaagactnaaaagctgttgctgcagcnattaattcaggaanagctaaagacgtgactgcttcttatganctcaatttagatcaaaacaccgtcacagcaatgatgaaaaccaacgcngacggntcngttgttttagcaatggggtataaatatttacttgtcttgccgtttgtagtgaaaaatgtagaaggcgattttgaaaatacagctgttcagctgacaaangatggngaaacggtaacaaatacagtgattaaccatgtgccaggtagtaatccttccaaagatgtaaaagcagataaaaacggtacagttggcagtgtttctctacatgataaagatattccgttacaaacaaaaatttattatgaagtgaaatcttccgaacgtccagcnaactatggcggaatnacngaagaatggggcatgaatgatgtcttggacacgacccatgatcgtttcacaggnaaatggcacgctattacnaantatgaccttaaagtagggganaaaacgttaaaagcaggaacagatatttctgcctacattcttttagaaaacaaagacaataaagacttgacgtttacnatgaatcaagcattattggcngcnttaaatgaaggaagcaataaagtaggcaaacaagcttggtctgtgtatctggaagtcgaacggatnaaaacaggtgacgtagaaaacacgcaaacagaaaactacaacaaagagcttgtncgttctaatacngtggtgacgcatacncctgatgatccaaaaccaaccaaagccgttcataacaagaaaggggaaganattaancatggaaaagtngctcgtggtgatgttctttcttatgaaatgacntgggacttaaaagggtacgataaagactttgcctttgatacagtcgatcttgcgacaggcgtttctttcttcgatgattacgatgaaacgaangtgacaccaatcaaagacttacttcgtgtcaaagattctaaaggggnagacattacgaaccagttcacgatctcntgggacgatgccaaaggcacggtgacnatntctgccaaagacccacaagcctttattctagcgnatggtgggcaagaattgcgtgtaacnctccctacaaaagtcaaagccgatgtttctggngatgtttataattcagcggaacaaaatacatttggncaacgaattaaaaccaatacngttgtcaaccatattccaaaagtgaancctaaaaaagacgtggttattaaagtnggtgacaaacaaagtcaaaatggngccacaatcaaattaggggagaanttcttctatgaatttacaagtagtgacattcctgcagaatacgctggngttgtggaagaatggtcgattagcgataaactagacgtcaaacatgacaaatttagtggccaatggtctgtgtttgccaattctaattttgttttagcagacggaaccaaagtgaataaaggggacgacatttcgaaactattcacgatgacctttgaacaaggggtagtgaaaatcacggccagtcaagcctttttngatgcgatgaatctaaaagaaaacaaaaacgttgcacactcatggaaagcgttcattggtgtagaacgaattgcggcaggagacgtttacaacacaatcgaagaatctttcaacaatgagaagattaaaacnaatacggtagtgacncatacgccagaaaaaccacaaacnccaccagaaaaaacagtgattgtaccaccaacaccaaaaacaccgcaagcaccagtagagccattagtggtagaaaaggcaagtgtngtgccagaattgccgcaaacaggcgaaaaacaaaatgtcttattaacggtagctggtagtttagccgcaatgcttggcttagcaggcttaggctttaaacgtagaaaagaaacaaaataa

SEQ ID NO: 244 - protein, 624 aa
VTIDLSKVKVYQADASLNXKDXKAVAAAINSGXAKDVTASYXLNLDQNTVTAMMKTNADGSVVLAMGYKYLLVLPFVVKNVEGDFENTAVQLTXDGETVTNTVINHVPGSNPSKDVKADKNGTVGSVSLHDKDIPLQTKIYYEVKSSERPANYGGXTEEWGMNDVLDTTHDRFTGKWHAITXYDLKVGXKTLKAGTDISAYILLENKDNKDLTFTMNQALLAALNEGSNKVGKQAWSVYLEVERXKTGDVENTQTENYNKELVRSNTVVTHTPDDPKPTKAVHNKKGEXIXHGKVARGDVLSYEMTWDLKGYDKDFAFDTVDLATGVSFFDDYDETXVTPIKDLLRVKDSKGXDITNQFTISWDDAKGTVTXSAKDPQAFILAXGGQELRVTLPTKVKADVSGDVYNSAEQNTFGQRIKTNTVVNHIPKVXPKKDVVIKVGDKQSQNGATIKLGEXFFYEFTSSDIPAEYAGVVEEWSISDKLDVKHDKFSGQWSVFANSNFVLADGTKVNKGDDISKLFTMTFEQGVVKITASQAFXDAMNLKENKNVAHSWKAFIGVERIAAGDVYNTIEESFNNEKIKTNTVVTHTPEKPQTPPEKTVIVPPTPKTPQAPVEPLVVEKASV

SEQ ID NO: 245 - DNA, 2916 bp; double-stranded, linear
tagcgaaagaaaatagggaggattaaaatgtttaagaaagcaacgaaattattatcgacaatggtgattgtcgctggaacagttgtgggaaatttcagtcccacattggctttagctgaagaagcggttaaagcaggagatacagaaggaatgaccaatacggtgaaagtgaaagacgacagtctggctgattgtaaacggatattggaaggacaagctactttcccagttcaagcgggtgaaacggaaccagtcgatttagtagttgttgaagatgctagtggtagtttttcagataattttccacatgtaagacaagcgattgatgaagtggttcaaggcttatctgatcaagaccgcgtgatgctggcttcatatcgcggcggaaaacaatttatgtttcctgatggaaagacaaaaattaattcagctgattatgatatgaatgtgcgcgtcaatacgcaattgacttatgataaaagccaatttgtctctggttttggagacgttcggacgtatggtggtacgccaaccgccccaggattgaaactcgctttagatacgtacaatcaaacacacggagatttaacgaatcgaaaaacgtatttcctattagtgacagatggggtcgctaatacacgtttagatggttacttgcataagaccaataccaatgattcaatcaatgaatatccagatccaagacatcctcttcaagtctcagtggaatatagtaatgactaccaaggtgcagcagcagaagttttagcgttaaaccaagaaattactaaccaaggctatgaaatgattaatgcgtattgggaaagtgttgaatctttaagttcagtgaattcatactttgataaatataaaacagaagtgggtccttttgtaaaacaagagttgcaacaagggtctagcacaccagaagattttattacaagccaatctattgatgattttacaacccaattaaaacaaattgtcaaagatcgtctggcgcaatcgacaccagcaacagcttcattaacgattgccaatcaatttgatattcaatctgcgaccgctacggacgatgctggaaatgatgtgcctgttcaaattaacggacaaaccatttcagcaactagtacagaaggttacgtaggaaacatcacgattcactacgaagtcaaagaaaatacagcgattgatgcagcaacccttgtaagtagtgggacaatgaatcaaggaacaattgctaaggaatttccagaagcgacgattcctaaaaatgacaatgcgcatgcgtgtgacgtgacgccagaagatccaacgattacaaaagatatcgaaaatcaagaacacttagatttaaccaatcgtgaagatagtttcgattggcatgtcaaaacagcctttggcaacgaaaccagtacttggacccaagccagcatggtggatgacattaataaagtgctagatatcattgatgtgaaagtcaccgacgaaaatggtaaagatgttacagctaacggcacagtaacacaagaaaataacaaagtaacttttgaaatgaacaaacaagcagacagctatgactatttaagtggtcatacgtatacaatgactatcaccactaaaattaaaactgacgcaacggacgaagaattagcgccttacattgaacaaggcgggattcccaaccaagccgacttaaactttggcaatgaaggtgacgtgttacattccaacaaaccaaccgtaacaccaccgccagttgatccaaatattgctaaagacgtagaaggacaagaacatttagatttaaccaaccgcgatcaagaatttaaatggaacgtcaaaacagctttcggtaacgaaacaagcacttggacccaagccagcatggtagatgacattaataaagtgttagacatcactgatgtaaaagtcacagatgaaaatggtaaagatgttacagctaacggcaaagtaacacaagaaaataacaaagtaacttttgaaatgaacaancaagcngacagctatgactatttaagtggtcatacgtacacaatgaccattactactaaaatcaaagctagcgcaacggacgaagaattagcaccttatattgaacaaggtggcattcccaaccaagccgacttgaactttggcaacgaaggtgacgtgttgcattccaacaaaccaaccgtaacaccacctgcaccaacgccagaagatccaacgattacaaaagatatcgaaggccaagaacatttagatttaaccaaccgtgaccaagaatttaaatggaacgtcaaaacagctttcggtaacgaaacaagcacatggacccaagccagcatggtggatgacattaataaagtgttagacatcacagacgtgaaagttnctgangaaaatggcaaagatgttacagataatggcatagtaacacaagaaaataacaaagtaacttttactatgaacaaaaaagatgacagctactcttacttagctggtcatacatacacaatgactattaccactaaaattaaaactgacgcaacggatgaagaattagcgccttatattgaacaaggcgggattcccaaccaagccgacttaaactttggcaacgaaggtgacgtgttgcattccaacaagccaaccgtaacaccgcctgcaccaacgccagaagacccaaaaaaacctgaacctaaacaaccgctaaaaccgaaaaaaccgttgacgcctacaaatcatcaagcaccaacgaacccagtcaattttggaaaatcagcaagtaaaggaattcatttaccaatgactaatacaacagtaaatccactttacatgatcgcaggtttaattgtccttatagtggctattagctttggcataacaaaaaataaaaaaagaaaaaattag

SEQ ID NO: 246 - protein, 962 aa
MFKKATKLLSTMVIVAGTVVGNFSPTLALAEEAVKAGDTEGMTNTVKVKDDSLADCKRILEGQATFPVQAGETEPVDLVVVEDASGSFSDNFPHVRQAIDEVVQGLSDQDRVMLASYRGGKQFMFPDGKTKINSADYDMNVRVNTQLTYDKSQFVSGFGDVRTYGGTPTAPGLKLALDTYNQTHGDLTNRKTYFLLVTDGVANTRLDGYLHKTNTNDSINEYPDPRHPLQVSVEYSNDYQGAAAEVLALNQEITNQGYEMINAYWESVESLSSVNSYFDKYKTEVGPFVKQELQQGSSTPEDFITSQSIDDFTTQLKQIVKDRLAQSTPATASLTIANQFDIQSATATDDAGNDVPVQINGQTISATSTEGYVGNITIHYEVKENTAIDAATLVSSGTMNQGTIAKEFPEATIPKNDNAHACDVTPEDPTITKDIENQEHLDLTNREDSFDWHVKTAFGNETSTWTQASMVDDINKVLDIIDVKVTDENGKDVTANGTVTQENNKVTFEMNKQADSYDYLSGHTYTMTITTKIKTDATDEELAPYIEQGGIPNQADLNFGNEGDVLHSNKPTVTPPPVDPNIAKDVEGQEHLDLTNRDQEFKWNVKTAFGNETSTWTQASMVDDINKVLDITDVKVTDENGKDVTANGKVTQENNKVTFEMNXQADSYDYLSGHTYTMTITTKIKASATDEELAPYIEQGGIPNQADLNFGNEGDVLHSNKPTVTPPAPTPEDPTITKDIEGQEHLDLTNRDQEFKWNVKTAFGNETSTWTQASMVDDINKVLDITDVKVXXENGKDVTDNGIVTQENNKVTFTMNKKDDSYSYLAGHTYTMTITTKIKTDATDEELAPYIEQGGIPNQADLNFGNEGDVLHSNKPTVTPPAPTPEDPKKPEPKQPLKPKKPLTPTNHQAPTNPVNFGKSASKGIHLPMTNTTVNPLYMIAGLIVLIVAISFGITKNKKRKN

SEQ ID NO: 247 - DNA, 2677 bp; double-stranded, linear
ggttaaagcaggagatacagaaggaatgaccaatacggtgaaagtgaaagacgacagtctggctgattgtaaacggatattggaaggacaagctactttcccagttcaagcgggtgaaacggaaccagtcgatttagtagttgttgaagatgctagtggtagtttttcagataattttccacatgtaagacaagcgattgatgaagtggttcaaggcttatctgatcaagaccgcgtgatgctggcttcatatcgcggcggaaaacaatttatgtttcctgatggaaagacaaaaattaattcagctgattatgatatgaatgtgcgcgtcaatacgcaattgacttatgataaaagccaatttgtctctggttttggagacgttcggacgtatggtggtacgccaaccgccccaggattgaaactcgctttagatacgtacaatcaaacacacggagatttaacgaatcgaaaaacgtatttcctattagtgacagatggggtcgctaatacacgtttagatggttacttgcataagaccaataccaatgattcaatcaatgaatatccagatccaagacatcctcttcaagtctcagtggaatatagtaatgactaccaaggtgcagcagcagaagttttagcgttaaaccaagaaattactaaccaaggctatgaaatgattaatgcgtattgggaaagtgttgaatctttaagttcagtgaattcatactttgataaatataaaacagaagtgggtccttttgtaaaacaagagttgcaacaagggtctagcacaccagaagattttattacaagccaatctattgatgattttacaacccaattaaaacaaattgtcaaagatcgtctggcgcaatcgacaccagcaacagcttcattaacgattgccaatcaatttgatattcaatctgcgaccgctacggacgatgctggaaatgatgtgcctgttcaaattaacggacaaaccatttcagcaactagtacagaaggttacgtaggaaacatcacgattcactacgaagtcaaagaaaatacagcgattgatgcagcaacccttgtaagtagtgggacaatgaatcaaggaacaattgctaaggaatttccagaagcgacgattcctaaaaatgacaatgcgcatgcgtgtgacgtgacgccagaagatccaacgattacaaaagatatcgaaaatcaagaacacttagatttaaccaatcgtgaagatagtttcgattggcatgtcaaaacagcctttggcaacgaaaccagtacttggacccaagccagcatggtggatgacattaataaagtgctagatatcattgatgtgaaagtcaccgacgaaaatggtaaagatgttacagctaacggcacagtaacacaagaaaataacaaagtaacttttgaaatgaacaaacaagcagacagctatgactatttaagtggtcatacgtatacaatgactatcaccactaaaattaaaactgacgcaacggacgaagaattagcgccttacattgaacaaggcgggattcccaaccaagccgacttaaactttggcaatgaaggtgacgtgttacattccaacaaaccaaccgtaacaccaccgccagttgatccaaatattgctaaagacgtagaaggacaagaacatttagatttaaccaaccgcgatcaagaatttaaatggaacgtcaaaacagctttcggtaacgaaacaagcacttggacccaagccagcatggtagatgacattaataaagtgttagacatcactgatgtaaaagtcacagatgaaaatggtaaagatgttacagctaacggcaaagtaacacaagaaaataacaaagtaacttttgaaatgaacaancaagcngacagctatgactatttaagtggtcatacgtacacaatgaccattactactaaaatcaaagctagcgcaacggacgaagaattagcaccttatattgaacaaggtggcattcccaaccaagccgacttgaactttggcaacgaaggtgacgtgttgcattccaacaaaccaaccgtaacaccacctgcaccaacgccagaagatccaacgattacaaaagatatcgaaggccaagaacatttagatttaaccaaccgtgaccaagaatttaaatggaacgtcaaaacagctttcggtaacgaaacaagcacatggacccaagccagcatggtggatgacattaataaagtgttagacatcacagacgtgaaagttnctgangaaaatggcaaagatgttacagataatggcatagtaacacaagaaaataacaaagtaacttttactatgaacaaaaaagatgacagctactcttacttagctggtcatacatacacaatgactattaccactaaaattaaaactgacgcaacggatgaagaattagcgccttatattgaacaaggcgggattcccaaccaagccgacttaaactttggcaacgaaggtgacgtgttgcattccaacaagccaaccgtaacaccgcctgcaccaacgccagaagacccaaaaaaacctgaacctaaacaaccgctaaaaccgaaaaaaccgttgacgcctacaaatcatcaagcaccaacgaacccagtcaattttggaaaatcagcaagtaaaggaatt

SEQ ID NO: 248 - protein, 894 aa
AVKAGDTEGMTNTVKVKDDSLADCKRILEGQATFPVQAGETEPVDLVVVEDASGSFSDNFPHVRQAIDEVVQGLSDQDRVMLASYRGGKQFMFPDGKTKINSADYDMNVRVNTQLTYDKSQFVSGFGDVRTYGGTPTAPGLKLALDTYNQTHGDLTNRKTYFLLVTDGVANTRLDGYLHKTNTNDSINEYPDPRHPLQVSVEYSNDYQGAAAEVLALNQEITNQGYEMINAYWESVESLSSVNSYFDKYKTEVGPFVKQELQQGSSTPEDFITSQSIDDFTTQLKQIVKDRLAQSTPATASLTIANQFDIQSATATDDAGNDVPVQINGQTISATSTEGYVGNITIHYEVKENTAIDAATLVSSGTMNQGTIAKEFPEATIPKNDNAHACDVTPEDPTITKDIENQEHLDLTNREDSFDWHVKTAFGNETSTWTQASMVDDINKVLDIIDVKVTDENGKDVTANGTVTQENNKVTFEMNKQADSYDYLSGHTYTMTITTKIKTDATDEELAPYIEQGGIPNQADLNFGNEGDVLHSNKPTVTPPPVDPNIAKDVEGQEHLDLTNRDQEFKWNVKTAFGNETSTWTQASMVDDINKVLDITDVKVTDENGKDVTANGKVTQENNKVTFEMNXQADSYDYLSGHTYTMTITTKIKASATDEELAPYIEQGGIPNQADLNFGNEGDVLHSNKPTVTPPAPTPEDPTITKDIEGQEHLDLTNRDQEFKWNVKTAFGNETSTWTQASMVDDINKVLDITDVKVXXENGKDVTDNGIVTQENNKVTFTMNKKDDSYSYLAGHTYTMTITTKIKTDATDEELAPYIEQGGIPNQADLNFGNEGDVLHSNKPTVTPPAPTPEDPKKPEPKQPLKPKKPLTPTNHQAPTNPVNFGKSASKGIH

SEQ ID NO: 249 - DNA, 2916 bp; double-stranded, linear; identical to SEQ ID NO: 245

SEQ ID NO: 250 - protein, 962 aa; identical to SEQ ID NO: 246

SEQ ID NO: 251 - DNA, 1358 bp; double-stranded, linear
ggttaaagcaggagatacagaaggaatgaccaatacggtgaaagtgaaagacgacagtctggctgattgtaaacggatattggaaggacaagctactttcccagttcaagcgggtgaaacggaaccagtcgatttagtagttgttgaagatgctagtggtagtttttcagataattttccacatgtaagacaagcgattgatgaagtggttcaaggcttatctgatcaagaccgcgtgatgctggcttcatatcgcggcggaaaacaatttatgtttcctgatggaaagacaaaaattaattcagctgattatgatatgaatgtgcgcgtcaatacgcaattgacttatgataaaagccaatttgtctctggttttggagacgttcggacgtatggtggtacgccaaccgccccaggattgaaactcgctttagatacgtacaatcaaacacacggagatttaacgaatcgaaaaacgtatttcctattagtgacagatggggtcgctaatacacgtttagatggttacttgcataagaccaataccaatgattcaatcaatgaatatccagatccaagacatcctcttcaagtctcagtggaatatagtaatgactaccaaggtgcagcagcagaagttttagcgttaaaccaagaaattactaaccaaggctatgaaatgattaatgcgtattgggaaagtgttgaatctttaagttcagtgaattcatactttgataaatataaaacagaagtgggtccttttgtaaaacaagagttgcaacaagggtctagcacaccagaagattttattacaagccaatctattgatgattttacaacccaattaaaacaaattgtcaaagatcgtctggcgcaatcgacaccagcaacagcttcattaacgattgccaatcaatttgatattcaatctgcgaccgctacggacgatgctggaaatgatgtgcctgttcaaattaacggacaaaccatttcagcaactagtacagaaggttacgtaggaaacatcacgattcactacgaagtcaaagaaaatacagcgattgatgcagcaacccttgtaagtagtgggacaatgaatcaaggaacaattgctaaggaatttccagaagcgacgattcctaaaaatgacaatgcgcatgcgtgtgacgtgacgccagaagatccaacgattacaaaagatatcgaaaatcaagaacacttagatttaaccaatcgtgaagatagtttcgattggcatgtcaaaacagcctttggcaacgaaaccagtacttggacccaagccagcatggtggatgacattaataaagtgctagatatcattgatgtgaaagtca

SEQ ID NO: 252 - protein, 454 aa
AVKAGDTEGMTNTVKVKDDSLADCKRILEGQATFPVQAGETEPVDLVVVEDASGSFSDNFPHVRQAIDEVVQGLSDQDRVMLASYRGGKQFMFPDGKTKINSADYDMNVRVNTQLTYDKSQFVSGFGDVRTYGGTPTAPGLKLALDTYNQTHGDLTNRKTYFLLVTDGVANTRLDGYLHKTNTNDSINEYPDPRHPLQVSVEYSNDYQGAAAEVLALNQEITNQGYEMINAYWESVESLSSVNSYFDKYKTEVGPFVKQELQQGSSTPEDFITSQSIDDFTTQLKQIVKDRLAQSTPATASLTIANQFDIQSATATDDAGNDVPVQINGQTISATSTEGYVGNITIHYEVKENTAIDAATLVSSGTMNQGTIAKEFPEATIPKNDNAHACDVTPEDPTITKDIENQEHLDLTNREDSFDWHVKTAFGNETSTWTQASMVDDINKVLDIIDVKVT

SEQ ID NO: 253 - DNA, 2916 bp; double-stranded, linear; identical to SEQ ID NO: 245

SEQ ID NO: 254 - protein, 962 aa; identical to SEQ ID NO: 246

SEQ ID NO: 255 - DNA, 1345 bp; double-stranded, linear
gctagatatcattgatgtgaaagtcaccgacgaaaatggtaaagatgttacagctaacggcacagtaacacaagaaaataacaaagtaacttttgaaatgaacaaacaagcagacagctatgactatttaagtggtcatacgtatacaatgactatcaccactaaaattaaaactgacgcaacggacgaagaattagcgccttacattgaacaaggcgggattcccaaccaagccgacttaaactttggcaatgaaggtgacgtgttacattccaacaaaccaaccgtaacaccaccgccagttgatccaaatattgctaaagacgtagaaggacaagaacatttagatttaaccaaccgcgatcaagaatttaaatggaacgtcaaaacagctttcggtaacgaaacaagcacttggacccaagccagcatggtagatgacattaataaagtgttagacatcactgatgtaaaagtcacagatgaaaatggtaaagatgttacagctaacggcaaagtaacacaagaaaataacaaagtaacttttgaaatgaacaancaagcngacagctatgactatttaagtggtcatacgtacacaatgaccattactactaaaatcaaagctagcgcaacggacgaagaattagcaccttatattgaacaaggtggcattcccaaccaagccgacttgaactttggcaacgaaggtgacgtgttgcattccaacaaaccaaccgtaacaccacctgcaccaacgccagaagatccaacgattacaaaagatatcgaaggccaagaacatttagatttaaccaaccgtgaccaagaatttaaatggaacgtcaaaacagctttcggtaacgaaacaagcacatggacccaagccagcatggtggatgacattaataaagtgttagacatcacagacgtgaaagttnctgangaaaatggcaaagatgttacagataatggcatagtaacacaagaaaataacaaagtaacttttactatgaacaaaaaagatgacagctactcttacttagctggtcatacatacacaatgactattaccactaaaattaaaactgacgcaacggatgaagaattagcgccttatattgaacaaggcgggattcccaaccaagccgacttaaactttggcaacgaaggtgacgtgttgcattccaacaagccaaccgtaacaccgcctgcaccaacgccagaagacccaaaaaaacctgaacctaaacaaccgctaaaaccgaaaaaaccgttgacgcctacaaatcatcaagcaccaacgaacccagtcaattttggaaaatcagcaagtaaaggaatt

SEQ ID NO: 256 - protein, 450 aa
VLDIIDVKVTDENGKDVTANGTVTQENNKVTFEMNKQADSYDYLSGHTYTMTITTKIKTDATDEELAPYIEQGGIPNQADLNFGNEGDVLHSNKPTVTPPPVDPNIAKDVEGQEHLDLTNRDQEFKWNVKTAFGNETSTWTQASMVDDINKVLDITDVKVTDENGKDVTANGKVTQENNKVTFEMNXQADSYDYLSGHTYTMTITTKIKASATDEELAPYIEQGGIPNQADLNFGNEGDVLHSNKPTVTPPAPTPEDPTITKDIEGQEHLDLTNRDQEFKWNVKTAFGNETSTWTQASMVDDINKVLDITDVKVXXENGKDVTDNGIVTQENNKVTFTMNKKDDSYSYLAGHTYTMTITTKIKTDATDEELAPYIEQGGIPNQADLNFGNEGDVLHSNKPTVTPPAPTPEDPKKPEPKQPLKPKKPLTPTNHQAPTNPVNFGKSASKGIH

SEQ ID NO: 257 - DNA, 4977 bp; double-stranded, linear
taggggaagctaatgatcttggtatttatcgtttattttaaagaaaagagggacgatcagatgaaaaagaaaattgttgaggattttaatcggaaaagtcagcataaaaaatggacaaaacgcaagatgcttaatttagcaatatcaagtggtttattatttacgtcattagcaatccctgtaagtatagctgttacctctggcacaatcagtgcatcagcagcggtcttggatatcgaactattatcaaatgttacgtcaaataatgacagtggcacttcaacgagtaatcgttggacagccgcaaaccaaaatcaaccagttaatttcacggtttctggtggcgctttagcagatgcttccgctgtgtttagtggacaaaaacaagcggtgttagtggttcctcctgagttaagaggaaatgtagctgcagcaggcagcgcagcaatcaataccaatgtcacgattgatctttcaaaagttacttttttgactgccgttttgaatgcagccaatgatttaaccaatgtgattactcaaattaccagtggggcgttagggaatttaactggtgttgatattgatttgacggaagtgaatcgtcaattggaattagttaataacattgaaaacttaggtgctgcttcatttacagctccggaaacgttagcagctgacggctcatacattagtgcaccgattagtgatggtttagggttagttttagcccaaaatgtttcaaacatcttacaagatttgaatgcggcagttcaagctttggaggcaaaaggtaccagtatcccaagtaatcttgtcgccgcagctataaatgcagccttgcttcctgtcaaaggcacggtaaacgtggctgtttcaggtgctttgcctttattagcggttggtggttcaggcgtaaatgagttagtggatgcttctttactaggcacaaccacggttactttaccaactaccgtttcaacacctcaaaatttatccaataatttagatgctcgttttgtaggaacagtcgttcaaacagatcttttagacgttaatttattagcaacagcagacggtgtatccaacatttattttgctgcaggcactactagtgaagtaaccgcaccaacaatcacaggagtaacaggtaattcaacagcaggttacgaagttaaaggaactgccgatgccaatgccacggttgaaatccgaaatgcaggaggcaccgtaataggcacaggtaccgctgatgggacaggagcgtttacagttaccgttcccgcaggtgaagcaggcgccaatgaaacgttaaccgccgtagcgaaaaacgccagcggnacagaaagnacgccaacaacgttccaaacnccagcggatgaagcaaccgtaaccgcaccaacaatcacaggagtgacaggtaattcaacggcaggttacgaagttaaaggaactgccgatgccaatgccacggttgaaatccgaaatgcaggaggcaccgtaataggcacaggtaccgctgatgggacaggagcgtttacagttaccgttcccgcaggtgaagcaggtgccaatgaaacgttaaccgccgtagcgaaaaacgccagcggcacagaaagtacgccaacaacgttccaaacaccagcggatgaagcaaccgtaaccgcaccaacaatcacaggagtgacaggtaattcaacagcaggttacgaagttaaaggaactgccgatgccaatgccacggttgagatccgaaatgcaggaggtgccgtgataggtacaggtactgctgatgggacaggggcatttacagttaccattcccgcaggtgaagcaggtgcgaatgaaacgttaaccgccgtagcgaaaaacgccagcggtacagaaagtacgccaacaacgttccaaacgccagcggatcctaatacgcccgtggcgacgccaattgttgagactgtaacaggtagtacaacaaaaggctatgaggtcaaagggactgctgaagttggcaccaccattgaggttcgcgatgcagctggcacggtccttggtactgcaacaactggaactgacggaaaatatacagtgactttagattcaggaacagcaacagcaaatcaaacgctgagcgttgtagcgaaaaacgctagtggcacggaaagtcaaccagcaacggcgacaacaccagctgatgtcactgcaccaacagttgataacatcacaggcaactctggttcgggttatgaaattacaggaacagcagaccctaacacaacaatcgaagttcgtgatccatctggggcagtcattggtacaggtacctctgatgcgaatggtgattttactgtaacgctaccaacgggaacgaccaatcctggggatacgttaacagtgattggaaaggataacgcgggaaatgaaagtcaaccgactgaagtccttgttcctgctgatgccacggttacagcaccaactgtaacaggagtaacaggtaattcagttgctggttatcaggtgacaggcaccgctgatccgaatgctaccatcgaaattcgtgatgcagatgggaacgtgattgcaacagggactgccgatgggactggttcctttgctgtgaaccttccagctgggacggcaaatgcgaatgaaacattgacagcgttagccaaagatcctgctggcaatacaagtacaccgacaaccttccaaacaccagcagatgaagtagtggcaccgccaagtgtcgacaaagttactgggaatacaacacaaggatatcaagtgacaggtaccgctgaacttggcaccaccattgaagttcgtgcaacagacggaacagttttaggcaccgcaacaactggaccgactggccaatatactgtgacgttagcttcaggaaaagcaacagctaaacaaacagtgaatgtagttgctaaaaatgatactggacttgagagtcaaccaactacagctatgacacccgctgatgttaccacaccaacaattggtgacattactggagattcaacaactggttatgaaatcactgggacggcggaccctaataccaccattgaagtacggaacccagatggaacaattattggtacaacgacaacggatgatcaaggaaactttactgtggaccttccagcgggagccgctaatcctggtgatacattaacagttgttggaaaagacggtgacggcaatgaaagtcaaccaacggaagtgacggtccctgaagatgcaaccgtagcagcaccaactgtgacgactgttacaggaacaactgccactgggtatcaagtaaccggcacggcagagccaaatgtcaccattgagattcacaatgaagcaggtttagttattgctacgggaacgactgatggtgctggcgcatttacaatcactcttccgacgggcacagcaacagctaacgaagccttaactgccattgcgaaagatgctgctgggaaagaaagtaatccgactgctttcaaaacacctgctgatccagatgcaccagtcgcgacacctactgttgacaaaatcactggtagcacgacaaacggctatcaagtagtaggagcagcagaagttggtacaacagttgaggtgcgtgacgccgatggcacagtccttggcatggcaactactggaactgatggcaaatacacagtgactttagagccagggaaggcctcagctaacgaaacaataactgtcgtagcgaaaaatgcaacaggaaaagaaagtcagccagctacagcaactacaccagtcgacttagccacaccaaccattgattctattaccggaaattctagtaaaggttacgaaatcactggaacggcggagccaaaaaccactattgatgtccgtgacgcagacggaaccatcattgctgctacaactgctaacgaaaccggccaatatacggtgactctaccagctggcgtagtgacaccaggagaaacgattacgattattagcaaagatggcgcaggtaatgaaagtcaaccagctacagccgttattccagcggatgttgttttagcggcgccaactattacgaaggttgaaggaaacaaagccaatggctatacagtcactggaactgctgatccaaatgtcacggttcaattttacaatagcagtgaacaattattggcaagtggcaatacaactactggaggtaccttctccgttcatattgcagcagggttagcaacagaaaaagaaacgttaaccgcactaaccacagatacacaaggaaatgtgagtcctaaaaccacatttatgacgccagccgatattacgggagaaccagagattaaaattgcggcaccaactgtttcttcagttttaggaacgtctaaagccggctacctcatcaaaggaacagctgaaccaaaccgaatcattcaaattagtaaccgactattaagaagtgtgattgctgtaggtgccaccgatgctgaaggcaacttcgctatccaattaacagcgggacaagcgactgctcaacaaagtttacttgcgacagctaccgatggcgcaggacattacagtacggctacaaccttcatgacgccagccgacccaacgaatcctggaggaggcaatggtaacactggcggaaataacggcaatacaggcggcaatacaggaaacaatggcgcaactggcgggaataatgggaatggttcaaacacaggttcaaatccaaatggaggttctggtttaggcacaacaggttctggcttaggttcactaggcaatggcctcggtacaaatggtagtggctaccaccctaaactaagtaccatcagttatggcactggaaatcacgggaaaacaggctacttacctagcacaggtgaaaaagagtcttcagccgtgacaacaagtttgtttggcgcctttgtcgcactccttgcgagcatgggaatcatcaaacgcaaacgtaaaaactag

SEQ ID NO: 258 - protein, 1638 aa
MKKKIVEDFNRKSQHKKWTKRKMLNLAISSGLLFTSLAIPVSIAVTSGTISASAAVLDIELLSNVTSNNDSGTSTSNRWTAANQNQPVNFTVSGGALADASAVFSGQKQAVLVVPPELRGNVAAAGSAAINTNVTIDLSKVTFLTAVLNAANDLTNVITQITSGALGNLTGVDIDLTEVNRQLELVNNIENLGAASFTAPETLAADGSYISAPISDGLGLVLAQNVSNILQDLNAAVQALEAKGTSIPSNLVAAAINAALLPVKGTVNVAVSGALPLLAVGGSGVNELVDASLLGTTTVTLPTTVSTPQNLSNNLDARFVGTVVQTDLLDVNLLATADGVSNIYFAAGTTSEVTAPTITGVTGNSTAGYEVKGTADANATVEIRNAGGTVIGTGTADGTGAFTVTVPAGEAGANETLTAVAKNASGTEXTPTTFQTPADEATVTAPTITGVTGNSTAGYEVKGTADANATVEIRNAGGTVIGTGTADGTGAFTVTVPAGEAGANETLTAVAKNASGTESTPTTFQTPADEATVTAPTITGVTGNSTAGYEVKGTADANATVEIRNAGGAVIGTGTADGTGAFTVTIPAGEAGANETLTAVAKNASGTESTPTTFQTPADPNTPVATPIVETVTGSTTKGYEVKGTAEVGTTIEVRDAAGTVLGTATTGTDGKYTVTLDSGTATANQTLSVVAKNASGTESQPATATTPADVTAPTVDNITGNSGSGYEITGTADPNTTIEVRDPSGAVIGTGTSDANGDFTVTLPTGTTNPGDTLTVIGKDNAGNESQPTEVLVPADATVTAPTVTGVTGNSVAGYQVTGTADPNATIEIRDADGNVIATGTADGTGSFAVNLPAGTANANETLTALAKDPAGNTSTPTTFQTPADEVVAPPSVDKVTGNTTQGYQVTGTAELGTTIEVRATDGTVLGTATTGPTGQYTVTLASGKATAKQTVNVVAKNDTGLESQPTTAMTPADVTTPTIGDITGDSTTGYEITGTADPNTTIEVRNPDGTIIGTTTTDDQGNFTVDLPAGAANPGDTLTVVGKDGDGNESQPTEVTVPEDATVAAPTVTTVTGTTATGYQVTGTAEPNVTIEIHNEAGLVIATGTTDGAGAFTITLPTGTATANEALTAIAKDAAGKESNPTAFKTPADPDAPVATPTVDKITGSTTNGYQVVGAAEVGTTVEVRDADGTVLGMATTGTDGKYTVTLEPGKASANETITVVAKNATGKESQPATATTPVDLATPTIDSITGNSSKGYEITGTAEPKTTIDVRDADGTIIAATTANETGQYTVTLPAGVVTPGETITIISKDGAGNESQPATAVIPADVVLAAPTITKVEGNKANGYTVTGTADPNVTVQFYNSSEQLLASGNTTTGGTFSVHIAAGLATEKETLTALTTDTQGNVSPKTTFMTPADITGEPEIKIAAPTVSSVLGTSKAGYLIKGTAEPNRIIQISNRLLRSVIAVGATDAEGNFAIQLTAGQATAQQSLLATATDGAGHYSTATTFMTPADPTNPGGGNGNTGGNNGNTGGNTGNNGATGGNNGNGSNTGSNPNGGSGLGTTGSGLGSLGNGLGTNGSGYHPKLSTISYGTGNHGKTGYLPSTGEKESSAVTTSLFGAFVALLASMGIIKRKRKN

SEQ ID NO: 259 - DNA, 1713 bp; double-stranded, linear
ctctggcacaatcagtgcatcagcagcggtcttggatatcgaactattatcaaatgttacgtcaaataatgacagtggcacttcaacgagtaatcgttggacagccgcaaaccaaaatcaaccagttaatttcacggtttctggtggcgctttagcagatgcttccgctgtgtttagtggacaaaaacaagcggtgttagtggttcctcctgagttaagaggaaatgtagctgcagcaggcagcgcagcaatcaataccaatgtcacgattgatctttcaaaagttacttttttgactgccgttttgaatgcagccaatgatttaaccaatgtgattactcaaattaccagtggggcgttagggaatttaactggtgttgatattgatttgacggaagtgaatcgtcaattggaattagttaataacattgaaaacttaggtgctgcttcatttacagctccggaaacgttagcagctgacggctcatacattagtgcaccgattagtgatggtttagggttagttttagcccaaaatgtttcaaacatcttacaagatttgaatgcggcagttcaagctttggaggcaaaaggtaccagtatcccaagtaatcttgtcgccgcagctataaatgcagccttgcttcctgtcaaaggcacggtaaacgtggctgtttcaggtgctttgcctttattagcggttggtggttcaggcgtaaatgagttagtggatgcttctttactaggcacaaccacggttactttaccaactaccgtttcaacacctcaaaatttatccaataatttagatgctcgttttgtaggaacagtcgttcaaacagatcttttagacgttaatttattagcaacagcagacggtgtatccaacatttattttgctgcaggcactactagtgaagtaaccgcaccaacaatcacaggagtaacaggtaattcaacagcaggttacgaagttaaaggaactgccgatgccaatgccacggttgaaatccgaaatgcaggaggcaccgtaataggcacaggtaccgctgatgggacaggagcgtttacagttaccgttcccgcaggtgaagcaggcgccaatgaaacgttaaccgccgtagcgaaaaacgccagcggnacagaaagnacgccaacaacgttccaaacnccagcggatgaagcaaccgtaaccgcaccaacaatcacaggagtgacaggtaattcaacggcaggttacgaagttaaaggaactgccgatgccaatgccacggttgaaatccgaaatgcaggaggcaccgtaataggcacaggtaccgctgatgggacaggagcgtttacagttaccgttcccgcaggtgaagcaggtgccaatgaaacgttaaccgccgtagcgaaaaacgccagcggcacagaaagtacgccaacaacgttccaaacaccagcggatgaagcaaccgtaaccgcaccaacaatcacaggagtgacaggtaattcaacagcaggttacgaagttaaaggaactgccgatgccaatgccacggttgagatccgaaatgcaggaggtgccgtgataggtacaggtactgctgatgggacaggggcatttacagttaccattcccgcaggtgaagcaggtgcgaatgaaacgttaaccgccgtagcgaaaaacgccagcggtacagaaagtacgccaacaacgttccaaacgcc

SEQ ID NO: 260 - protein, 392 aa
TSGTISASAAVLDIELLSNVTSNNDSGTSTSNRWTAANQNQPVNFTVSGGALADASAVFSGQKQAVLVVPPELRGNVAAAGSAAINTNVTIDLSKVTFLTAVLNAANDLTNVITQITSGALGNLTGVDIDLTEVNRQLELVNNIENLGAASFTAPETLAADGSYISAPISDGLGLVLAQNVSNILQDLNAAVQALEAKGTSIPSNLVAAAINAALLPVKGTVNVAVSGALPLLAVGGSGVNELVDASLLGTTTVTLPTTVSTPQNLSNNLDARFVGTVVQTDLLDVNLLATADGVSNIYFAAGTTSEVTAPTITGVTGNSTAGYEVKGTADANATVEIRNAGGTVIGTGTADGTGAFTVTVPAGEAGANETLTAVAKNASGTEXTPTTFQTP

SEQ ID NO: 261 - DNA, 4977 bp; double-stranded, linear; identical to SEQ ID NO: 257

SEQ ID NO: 262 - protein, 1638 aa; identical to SEQ ID NO: 258

SEQ ID NO: 263 - DNA, 1463 bp; double-stranded, linear
aggtgaagcaggtgcgaatgaaacgttaaccgccgtagcgaaaaacgccagcggtacagaaagtacgccaacaacgttccaaacgccagcggatcctaatacgcccgtggcgacgccaattgttgagactgtaacaggtagtacaacaaaaggctatgaggtcaaagggactgctgaagttggcaccaccattgaggttcgcgatgcagctggcacggtccttggtactgcaacaactggaactgacggaaaatatacagtgactttagattcaggaacagcaacagcaaatcaaacgctgagcgttgtagcgaaaaacgctagtggcacggaaagtcaaccagcaacggcgacaacaccagctgatgtcactgcaccaacagttgataacatcacaggcaactctggttcgggttatgaaattacaggaacagcagaccctaacacaacaatcgaagttcgtgatccatctggggcagtcattggtacaggtacctctgatgcgaatggtgattttactgtaacgctaccaacgggaacgaccaatcctggggatacgttaacagtgattggaaaggataacgcgggaaatgaaagtcaaccgactgaagtccttgttcctgctgatgccacggttacagcaccaactgtaacaggagtaacaggtaattcagttgctggttatcaggtgacaggcaccgctgatccgaatgctaccatcgaaattcgtgatgcagatgggaacgtgattgcaacagggactgccgatgggactggttcctttgctgtgaaccttccagctgggacggcaaatgcgaatgaaacattgacagcgttagccaaagatcctgctggcaatacaagtacaccgacaaccttccaaacaccagcagatgaagtagtggcaccgccaagtgtcgacaaagttactgggaatacaacacaaggatatcaagtgacaggtaccgctgaacttggcaccaccattgaagttcgtgcaacagacggaacagttttaggcaccgcaacaactggaccgactggccaatatactgtgacgttagcttcaggaaaagcaacagctaaacaaacagtgaatgtagttgctaaaaatgatactggacttgagagtcaaccaactacagctatgacacccgctgatgttaccacaccaacaattggtgacattactggagattcaacaactggttatgaaatcactgggacggcggaccctaataccaccattgaagtacggaacccagatggaacaattattggtacaacgacaacggatgatcaaggaaactttactgtggaccttccagcgggagccgctaatcctggtgatacattaacagttgttggaaaagacggtgacggcaatgaaagtcaaccaacggaagtgacggtccctgaagatgcaaccgtagcagcaccaactgtgacgactgttacaggaa

SEQ ID NO: 264 - protein, 669 aa
AGEAGANETLTAVAKNASGTEXTPTTFQTPADEATVTAPTITGVTGNSTAGYEVKGTADANATVEIRNAGGTVIGTGTADGTGAFTVTVPAGEAGANETLTAVAKNASGTESTPTTFQTPADEATVTAPTITGVTGNSTAGYEVKGTADANATVEIRNAGGAVIGTGTADGTGAFTVTIPAGEAGANETLTAVAKNASGTESTPTTFQTPADPNTPVATPIVETVTGSTTKGYEVKGTAEVGTTIEVRDAAGTVLGTATTGTDGKYTVTLDSGTATANQTLSVVAKNASGTESQPATATTPADVTAPTVDNITGNSGSGYEITGTADPNTTIEVRDPSGAVIGTGTSDANGDFTVTLPTGTTNPGDTLTVIGKDNAGNESQPTEVLVPADATVTAPTVTGVTGNSVAGYQVTGTADPNATIEIRDADGNVIATGTADGTGSFAVNLPAGTANANETLTALAKDPAGNTSTPTTFQTPADEVVAPPSVDKVTGNTTQGYQVTGTAELGTTIEVRATDGTVLGTATTGPTGQYTVTLASGKATAKQTVNVVAKNDTGLESQPTTAMTPADVTTPTIGDITGDSTTGYEITGTADPNTTIEVRNPDGTIIGTTTTDDQGNFTVDLPAGAANPGDTLTVVGKDGDGNESQPTEVTVPEDATVAAPTVTTVTGT

SEQ ID NO: 265 - DNA, 4977 bp; double-stranded, linear; identical to SEQ ID NO: 257

SEQ ID NO: 266 - protein, 1638 aa; identical to SEQ ID NO: 258

SEQ ID NO: 267 - DNA, 1670 bp; double-stranded, linear
cggtgacggcaatgaaagtcaaccaacggaagtgacggtccctgaagatgcaaccgtagcagcaccaactgtgacgactgttacaggaacaactgccactgggtatcaagtaaccggcacggcagagccaaatgtcaccattgagattcacaatgaagcaggtttagttattgctacgggaacgactgatggtgctggcgcatttacaatcactcttccgacgggcacagcaacagctaacgaagccttaactgccattgcgaaagatgctgctgggaaagaaagtaatccgactgctttcaaaacacctgctgatccagatgcaccagtcgcgacacctactgttgacaaaatcactggtagcacgacaaacggctatcaagtagtaggagcagcagaagttggtacaacagttgaggtgcgtgacgccgatggcacagtccttggcatggcaactactggaactgatggcaaatacacagtgactttagagccagggaaggcctcagctaacgaaacaataactgtcgtagcgaaaaatgcaacaggaaaagaaagtcagccagctacagcaactacaccagtcgacttagccacaccaaccattgattctattaccggaaattctagtaaaggttacgaaatcactggaacggcggagccaaaaaccactattgatgtccgtgacgcagacggaaccatcattgctgctacaactgctaacgaaaccggccaatatacggtgactctaccagctggcgtagtgacaccaggagaaacgattacgattattagcaaagatggcgcaggtaatgaaagtcaaccagctacagccgttattccagcggatgttgttttagcggcgccaactattacgaaggttgaaggaaacaaagccaatggctatacagtcactggaactgctgatccaaatgtcacggttcaattttacaatagcagtgaacaattattggcaagtggcaatacaactactggaggtaccttctccgttcatattgcagcagggttagcaacagaaaaagaaacgttaaccgcactaaccacagatacacaaggaaatgtgagtcctaaaaccacatttatgacgccagccgatattacgggagaaccagagattaaaattgcggcaccaactgtttcttcagttttaggaacgtctaaagccggctacctcatcaaaggaacagctgaaccaaaccgaatcattcaaattagtaaccgactattaagaagtgtgattgctgtaggtgccaccgatgctgaaggcaacttcgctatccaattaacagcgggacaagcgactgctcaacaaagtttacttgcgacagctaccgatggcgcaggacattacagtacggctacaaccttcatgacgccagccgacccaacgaatcctggaggaggcaatggtaacactggcggaaataacggcaatacaggcggcaatacaggaaacaatggcgcaactggcgggaataatgggaatggttcaaacacaggttcaaatccaaatggaggttctggtttaggcacaacaggttctggcttaggttcactaggcaatggcctcggtacaaatggtagtggctaccaccctaaactaagtaccatcagttatggcactggaaatcacgggaaaacaggctact

SEQ ID NO: 268 - protein, 558 aa
DGDGNESQPTEVTVPEDATVAAPTVTTVTGTTATGYQVTGTAEPNVTIEIHNEAGLVIATGTTDGAGAFTITLPTGTATANEALTAIAKDAAGKESNPTAFKTPADPDAPVATPTVDKITGSTTNGYQVVGAAEVGTTVEVRDADGTVLGMATTGTDGKYTVTLEPGKASANETITVVAKNATGKESQPATATTPVDLATPTIDSITGNSSKGYEITGTAEPKTTIDVRDADGTIIAATTANETGQYTVTLPAGVVTPGETITIISKDGAGNESQPATAVIPADVVLAAPTITKVEGNKANGYTVTGTADPNVTVQFYNSSEQLLASGNTTTGGTFSVHIAAGLATEKETLTALTTDTQGNVSPKTTFMTPADITGEPEIKIAAPTVSSVLGTSKAGYLIKGTAEPNRIIQISNRLLRSVIAVGATDAEGNFAIQLTAGQATAQQSLLATATDGAGHYSTATTFMTPADPTNPGGGNGNTGGNNGNTGGNTGNNGATGGNNGNGSNTGSNPNGGSGLGTTGSGLGSLGNGLGTNGSGYHPKLSTISYGTGNHGKTGYL

SEQ ID NO: 269 - DNA, 771 bp; double-stranded, linear
taagtagaagtggtcgggacaaacgtagaactttcgctgattgccgaagaaattacttctgtcccgccatttatctgcaggtttaagccgtggaagggaagttattttgactttcctttcatggcttttttaagaaaggagcatgctatgtttaaaaaattaatgattcaacttgctttagtgattggtttaagtttaacgattccgatgacggcttncgcttacaccatcgaagcggatccaatcaactttacttattttcccggctctgcaagcaatgaattaattgttttacatgaatctggaaacgagcggaacctaggaccacacagtttagacaatgaagtggcctatatgaaacgaaattggtcaaatgcttatgtctcatattttgtcggatctggtggacgagtgaaacaattagctcctgctggccaaattcaatatggcgcaggttctttagctaatcaaaaagcctatgcgcaaatcgaattggctcgaacgaataatgcggcgacatttaaaaaagattatgctgcctatgttaatttggcccgtgatttggctcagaacattggtgctgatttttctctggacgatggaacaggttatggcatagtcactcatgattggattacaaaaaattggtggggagatcatacagatccttatggttatttagcgcgtgggggattagtaaagcgcattggcacnagatttacaacgggcgtttcngnaacaggtgagactggtcattattcagccaggtaa

SEQ ID NO: 270 - protein, 207 aa
MFKKLMIQLALVIGLSLTIPMTAXAYTIEADPINFTYFPGSASNELIVLHESGNERNLGPHSLDNEVAYMKRNWSNAYVSYFVGSGGRVKQLAPAGQIQYGAGSLANQKAYAQIELARTNNAATFKKDYAAYVNLARDLAQNIGADFSLDDGTGYGIVTHDWITKNWWGDHTDPYGYLARGGLVKRIGTRFTTGVSXTGETGHYSAR

SEQ ID NO: 271 - DNA, 620 bp; double-stranded, linear
gtttaaaaaattaatgattcaacttgctttagtgattggtttaagtttaacgattccgatgacggcttncgcttacaccatcgaagcggatccaatcaactttacttattttcccggctctgcaagcaatgaattaattgttttacatgaatctggaaacgagcggaacctaggaccacacagtttagacaatgaagtggcctatatgaaacgaaattggtcaaatgcttatgtctcatattttgtcggatctggtggacgagtgaaacaattagctcctgctggccaaattcaatatggcgcaggttctttagctaatcaaaaagcctatgcgcaaatcgaattggctcgaacgaataatgcggcgacatttaaaaaagattatgctgcctatgttaatttggcccgtgatttggctcagaacattggtgctgatttttctctggacgatggaacaggttatggcatagtcactcatgattggattacaaaaaattggtggggagatcatacagatccttatggttatttagcgcgtgggggattagtaaagcgcattggcacnagatttacaacgggcgtttcngnaacaggtgagactggtcattattcagccaggt

SEQ ID NO: 272 - protein, 206 aa
FKKLMIQLALVIGLSLTIPMTAXAYTIEADPINFTYFPGSASNELIVLHESGNERNLGPHSLDNEVAYMKRNWSNAYVSYFVGSGGRVKQLAPAGQIQYGAGSLANQKAYAQIELARTNNAATFKKDYAAYVNLARDLAQNIGADFSLDDGTGYGIVTHDWITKNWWGDHTDPYGYLARGGLVKRIGTRFTTGVSXTGETGHYSAR

SEQ ID NO: 273 - DNA, 1299 bp; double-stranded, linear
taatcaatgaaaaacgcacgttggttaagtatttgcgtcatgctactcgctcttttcgggttttcacagcaagcattagcagaggcatcgcaagcaagcgttcaagttacgttgcacaaattattgttccctgatggtcaattaccagaacagcagcaaaacacaggggaagagggaacgctgcttcaaaattatcggggcttaaatgacgtcacttatcaagtctatgatgtgacggatccgttttatcagcttcgttctgaaggaaaaacggtccaagaggcacagcgtcaattagcagaaaccggtgcaacaaatagaaaaccgatcgcagaagataaaacacagacaataaatggagaagatggagtggtttctttttcattagctagcaaagattcgcagcaacgagataaagcctatttatttgttgaagcggaagcaccagaagtggtaaaggaaaaagctagcaacctagtagtgattttgcctgttcaagatccacaagggcaatcgttaacgcatattcatttatatccaaaaaatgaagaaaatgcctatgacttaccaccacttgaaaaaacggtactcgataagcaacaaggctttaatcaaggagagcacattaactatcagttaacgactcagattccagcgaatattttaggatatcaggaattccgtttgtcagataaggcggatacaacgttgacacttttaccagaatcaattgaggtaaaagtggctggaaaaacagttactacaggttacacactgacgacgcaaaagcatggatttacgcttgatttttcaattaaagacttacaaaactttgcaaatcaaacaatgactgtgtcgtatcaaatgcgtttagaaaagaccgctgaacctgacactgcgattaacaacgaaggacaattagtcacggacaaacataccttgactaaaagagccacagttcgtacaggcggcaagtcttttgtcaaagttgatagtgaaaatgcgaaaatcaccttgccagaggctgtttttatcgtcaaaaatcaagcgggggaatacctcaatgaaacagcaaacgggtatcgttggcaaaaagaaaaagcattagctaaaaaattcacgtctaatcaagccggtgaattttcagttaaaggnnttaaaagatggccagtacttcttggaagaaatctctgcaccaaaaggttatcttctgaatcaaacagaaattccttttacggtgggaaaaaattcttatgcaacgaacggacaacgaacagcaccgttacatgtaatcaataa

SEQ ID NO: 274 - protein, 430 aa
MKNARWLSICVMLLALFGFSQQALAEASQASVQVTLHKLLFPDGQLPEQQQNTGEEGTLLQNYRGLNDVTYQVYDVTDPFYQLRSEGKTVQEAQRQLAETGATNRKPIAEDKTQTINGEDGVVSFSLASKDSQQRDKAYLFVEAEAPEVVKEKASNLVVILPVQDPQGQSLTHIHLYPKNEENAYDLPPLEKTVLDKQQGFNQGEHINYQLTTQIPANILGYQEFRLSDKADTTLTLLPESIEVKVAGKTVTTGYTLTTQKHGFTLDFSIKDLQNFANQTMTVSYQMRLEKTAEPDTAINNEGQLVTDKHTLTKRATVRTGGKSFVKVDSENAKITLPEAVFIVKNQAGEYLNETANGYRWQKEKALAKKFTSNQAGEFSVKGXKRWPVLLGRNLCTKRLSSESNRNSFYGGKKFLCNERTTNSTVTCNQ

SEQ ID NO: 275 - DNA, 1151 bp; double-stranded, linear
attaccagaacagcagcaaaacacaggggaagagggaacgctgcttcaaaattatcggggcttaaatgacgtcacttatcaagtctatgatgtgacggatccgttttatcagcttcgttctgaaggaaaaacggtccaagaggcacagcgtcaattagcagaaaccggtgcaacaaatagaaaaccgatcgcagaagataaaacacagacaataaatggagaagatggagtggtttctttttcattagctagcaaagattcgcagcaacgagataaagcctatttatttgttgaagcggaagcaccagaagtggtaaaggaaaaagctagcaacctagtagtgattttgcctgttcaagatccacaagggcaatcgttaacgcatattcatttatatccaaaaaatgaagaaaatgcctatgacttaccaccacttgaaaaaacggtactcgataagcaacaaggctttaatcaaggagagcacattaactatcagttaacgactcagattccagcgaatattttaggatatcaggaattccgtttgtcagataaggcggatacaacgttgacacttttaccagaatcaattgaggtaaaagtggctggaaaaacagttactacaggttacacactgacgacgcaaaagcatggatttacgcttgatttttcaattaaagacttacaaaactttgcaaatcaaacaatgactgtgtcgtatcaaatgcgtttagaaaagaccgctgaacctgacactgcgattaacaacgaaggacaattagtcacggacaaacataccttgactaaaagagccacagttcgtacaggcggcaagtcttttgtcaaagttgatagtgaaaatgcgaaaatcaccttgccagaggctgtttttatcgtcaaaaatcaagcgggggaatacctcaatgaaacagcaaacgggtatcgttggcaaaaagaaaaagcattagctaaaaaattcacgtctaatcaagccggtgaattttcagttaaaggnnttaaaagatggccagtacttcttggaagaaatctctgcaccaaaaggttatcttctgaatcaaacagaaattccttttacggtgggaaaaaattcttatgcaacgaacggacaacgaacagcaccgttacatgta

SEQ ID NO: 276 - protein, 384 aa
QLPEQQQNTGEEGTLLQNYRGLNDVTYQVYDVTDPFYQLRSEGKTVQEAQRQLAETGATNRKPIAEDKTQTINGEDGVVSFSLASKDSQQRDKAYLFVEAEAPEVVKEKASNLVVILPVQDPQGQSLTHIHLYPKNEENAYDLPPLEKTVLDKQQGFNQGEHINYQLTTQIPANILGYQEFRLSDKADTTLTLLPESIEVKVAGKTVTTGYTLTTQKHGFTLDFSIKDLQNFANQTMTVSYQMRLEKTAEPDTAINNEGQLVTDKHTLTKRATVRTGGKSFVKVDSENAKITLPEAVFIVKNQAGEYLNETANGYRWQKEKALAKKFTSNQAGEFSVKGXKRWPVLLGRNLCTKRLSSESNRNSFYGGKKFLCNERTTNSTVTC

SEQ ID NO: 277 - DNA, 684 bp; double-stranded, linear
taaatgaacaaattaaatacaaaattactgattggctatattcttttaggagccttaatcattgctgtcgctagagaatatggcttcttcgcttttgtgattctggtaggctttttagtattcgttctctatcgaaaaaagaaaaatgccgccgacaaaagcgatcaaatgccttacttaacgaaagataaagaagcccattatcgtgagttggggttatctccacaagaaattgattttttcagaagtacaatgagcacagccaaaaaacaaatcatacaattgcaagaaaacatgaatcgttcaactaaattacgggcgattgacttacgtaatgatactacgaaggtttctaaagctctgtttaaagagttagtgaaagaacctaaaaagttacacttagccaatcactttctctatacacatttaccaaatatcgttgacttaacaagtaaacatttagaaatcgaacaacacgaagtaaaaaacaaacaaacgtatgaaaaattagaagaaagcgcacaaatcattgaccaattgtcaaaattagttaaaaatgattatgaggaaatcgtttccgatgacttagacgatttagatgtcgaaatgtcgatcgctaaaagcagcttgtcgcaaaaagctgcaactgaggaatcacctcaagtaaacgaagaccagcaataa

SEQ ID NO: 278 - protein, 226 aa
MNKLNTKLLIGYILLGALIIAVAREYGFFAFVILVGFLVFVLYRKKKNAADKSDQMPYLTKDKEAHYRELGLSPQEIDFFRSTMSTAKKQIIQLQENMNRSTKLRAIDLRNDTTKVSKALFKELVKEPKKLHLANHFLYTHLPNIVDLTSKHLEIEQHEVKNKQTYEKLEESAQIIDQLSKLVKNDYEEIVSDDLDDLDVEMSIAKSSLSQKAATEESPQVNEDQQ

SEQ ID NO: 279 - DNA, 554 bp; double-stranded, linear
ctatcgaaaaaagaaaaatgccgccgacaaaagcgatcaaatgccttacttaacgaaagataaagaagcccattatcgtgagttggggttatctccacaagaaattgattttttcagaagtacaatgagcacagccaaaaaacaaatcatacaattgcaagaaaacatgaatcgttcaactaaattacgggcgattgacttacgtaatgatactacgaaggtttctaaagctctgtttaaagagttagtgaaagaacctaaaaagttacacttagccaatcactttctctatacacatttaccaaatatcgttgacttaacaagtaaacatttagaaatcgaacaacacgaagtaaaaaacaaacaaacgtatgaaaaattagaagaaagcgcacaaatcattgaccaattgtcaaaattagttaaaaatgattatgaggaaatcgtttccgatgacttagacgatttagatgtcgaaatgtcgatcgctaaaagcagcttgtcgcaaaaagctgcaactgaggaatcacctcaagtaaacgaagaccagcaat

SEQ ID NO: 280 - protein, 184 aa
YRKKKNAADKSDQMPYLTKDKEAHYRELGLSPQEIDFFRSTMSTAKKQIIQLQENMNRSTKLRAIDLRNDTTKVSKALFKELVKEPKKLHLANHFLYTHLPNIVDLTSKHLEIEQHEVKNKQTYEKLEESAQIIDQLSKLVKNDYEEIVSDDLDDLDVEMSIAKSSLSQKAATEESPQVNEDQQ

SEQ ID NO: 281 - DNA, 795 bp; double-stranded, linear
taaaggagttctcaaaaaatgaagctaaaaaaaataattcctgcttttccccttctttcaaccgttgcagttggcttgtggttaacgcctactcaagcttctgcagatgctgcggatacgatggtagatatctctggcaaaaaagtgttggttggatattggcataactgggcctcaaaaggacgcgatggttacaaacaaggaacatcagcatcactaaacctttcagaagtaaatcaagcctacaatgtcgtaccggtttccttcatgaaaagcgatggcacgacacggattcctacgttcaagccttataaccaaacggacactgccttccgacaagaagtcgcacaattaaatagtcaaggtcgcgcagttttattggcacttggtggagcagatgcacatattcaattagtcaaaggcgatgaacaagcctttgcgaatgaaatcattcgtcaagtggaaacatacggctttgatggtttagacatcgacttagagcaattggcgattactgctggcgacaaccaaaccgtcatccctgctacgttgaaaatagtcaaagaccattatcgagcacaaggaaaaaatttcatcattacgatggcaccagaattcccttatttaaaacctggtgccgcttatgaaacatacattacttccctaaatggttattatgattacattgccccacaattatataaccaaggcggcgacggtgtctgggttgatgaagttatgacttgggttgctcaaagcaacgatgctctaaaatacgagttcctctatnatatt

SEQ ID NO: 282 - protein, 259 aa
MKLKKIIPAFPLLSTVAVGLWLTPTQASADAADTMVDISGKKVLVGYWHNWASKGRDGYKQGTSASLNLSEVNQAYNVVPVSFMKSDGTTRIPTFKPYNQTDTAFRQEVAQLNSQGRAVLLALGGADAHIQLVKGDEQAFANEIIRQVETYGFDGLDIDLEQLAITAGDNQTVIPATLKIVKDHYRAQGKNFIITMAPEFPYLKPGAAYETYITSLNGYYDYIAPQLYNQGGDGVWVDEVMTWVAQSNDALKYEFLYXI

SEQ ID NO: 283 - DNA, 680 bp; double-stranded, linear
tgctgcggatacgatggtagatatctctggcaaaaaagtgttggttggatattggcataactgggcctcaaaaggacgcgatggttacaaacaaggaacatcagcatcactaaacctttcagaagtaaatcaagcctacaatgtcgtaccggtttccttcatgaaaagcgatggcacgacacggattcctacgttcaagccttataaccaaacggacactgccttccgacaagaagtcgcacaattaaatagtcaaggtcgcgcagttttattggcacttggtggagcagatgcacatattcaattagtcaaaggcgatgaacaagcctttgcgaatgaaatcattcgtcaagtggaaacatacggctttgatggtttagacatcgacttagagcaattggcgattactgctggcgacaaccaaaccgtcatccctgctacgttgaaaatagtcaaagaccattatcgagcacaaggaaaaaatttcatcattacgatggcaccagaattcccttatttaaaacctggtgccgcttatgaaacatacattacttccctaaatggttattatgattacattgccccacaattatataaccaaggcggcgacggtgtctgggttgatgaagttatgacttgggttgctcaaagcaacgatgctctaaaatacgagttcctct

SEQ ID NO: 284 - protein, 227 aa
AADTMVDISGKKVLVGYWHNWASKGRDGYKQGTSASLNLSEVNQAYNVVPVSFMKSDGTTRIPTFKPYNQTDTAFRQEVAQLNSQGRAVLLALGGADAHIQLVKGDEQAFANEIIRQVETYGFDGLDIDLEQLAITAGDNQTVIPATLKIVKDHYRAQGKNFIITMAPEFPYLKPGAAYETYITSLNGYYDYIAPQLYNQGGDGVWVDEVMTWVAQSNDALKYEFLY

SEQ ID NO: 285 - DNA, 963 bp; double-stranded, linear
taacctataagaaaaaaatcacaacctgtgataaattattggaggnaaaatatgtcaaaagggaagaaaatttttgccattatcnttggaattatcttggntctatttcttgcagttgttggaatgggagcaaaactttattgggatgtttctaaatcaatggataaaacctatgaaacagtagaacgatctaaaaaaagtcaggtcaatttaaacaataaggagcctttttctgttttattattagggattgatacaggcgatgatgggcgtgtcgagcaaggtcgttcggatacaacaattgttgcaacagttaatcctcgtgacaagcaaacaaccttagtcagtcttgctcgcgatacctatgttgatattccaggtcaaggaaaacaagataaattgaatcacgcctatgcttttggtggcgcatctttagcaatggacacagttgaaaactatttaaacatacctattaatcattatgtttcaattaatatggctggtttaaaagaattagtcaacgcggttggcggaatcgaagtgaacaataatctgactttttctcaagacggatatgattttacgattggtaaaatttcattggatggtgaacaagcactctcctattcaagaatgcgttacgaagaccctaatggtgactacggccgccaagaacgtcaaagaaaagtgattgaaggcatcgtccaaaaagtcttaagtcttaacagcgtaagcaactatcaagaaattttaacagctgtttctgataatatgaagacagatttaagttttgatgacatgaaaaaaattgccttagattatcgcagtgcctttggtaaagtgaaacaagaccaacttcaaggtactggttttatgcaagatggtgtttcctatcaacgtgtggatgaacaagaattaactcgtgtccaacaagagttgaaaaatcaattgaatacaaaataa

SEQ ID NO: 286 - protein, 303 aa
MSKGKKIFAIIXGIILXLFLAVVGMGAKLYWDVSKSMDKTYETVERSKKSQVNLNNKEPFSVLLLGIDTGDDGRVEQGRSDTTIVATVNPRDKQTTLVSLARDTYVDIPGQGKQDKLNHAYAFGGASLAMDTVENYLNIPINHYVSINMAGLKELVNAVGGIEVNNNLTFSQDGYDFTIGKISLDGEQALSYSRMRYEDPNGDYGRQERQRKVIEGIVQKVLSLNSVSNYQEILTAVSDNMKTDLSFDDMKKIALDYRSAFGKVKQDQLQGTGFMQDGVSYQRVDEQELTRVQQELKNQLNTK

SEQ ID NO: 287 - DNA, 826 bp; double-stranded, linear
actttattgggatgtttctaaatcaatggataaaacctatgaaacagtagaacgatctaaaaaaagtcaggtcaatttaaacaataaggagcctttttctgttttattattagggattgatacaggcgatgatgggcgtgtcgagcaaggtcgttcggatacaacaattgttgcaacagttaatcctcgtgacaagcaaacaaccttagtcagtcttgctcgcgatacctatgttgatattccaggtcaaggaaaacaagataaattgaatcacgcctatgcttttggtggcgcatctttagcaatggacacagttgaaaactatttaaacatacctattaatcattatgtttcaattaatatggctggtttaaaagaattagtcaacgcggttggcggaatcgaagtgaacaataatctgactttttctcaagacggatatgattttacgattggtaaaatttcattggatggtgaacaagcactctcctattcaagaatgcgttacgaagaccctaatggtgactacggccgccaagaacgtcaaagaaaagtgattgaaggcatcgtccaaaaagtcttaagtcttaacagcgtaagcaactatcaagaaattttaacagctgtttctgataatatgaagacagatttaagttttgatgacatgaaaaaaattgccttagattatcgcagtgcctttggtaaagtgaaacaagaccaacttcaaggtactggttttatgcaagatggtgtttcctatcaacgtgtggatgaacaagaattaactcgtgtccaacaagagttgaaaaatcaattgaatacaaaa

SEQ ID NO: 288 - protein, 276 aa
KLYWDVSKSMDKTYETVERSKKSQVNLNNKEPFSVLLLGIDTGDDGRVEQGRSDTTIVATVNPRDKQTTLVSLARDTYVDIPGQGKQDKLNHAYAFGGASLAMDTVENYLNIPINHYVSINMAGLKELVNAVGGIEVNNNLTFSQDGYDFTIGKISLDGEQALSYSRMRYEDPNGDYGRQERQRKVIEGIVQKVLSLNSVSNYQEILTAVSDNMKTDLSFDDMKKIALDYRSAFGKVKQDQLQGTGFMQDGVSYQRVDEQELTRVQQELKNQLNTK

SEQ ID NO: 289 - DNA, 423 bp; double-stranded, linear
tagaaaataacagaggagctgaaggaaatgaaagcatcaacaaaaattggtatcggtttaagcattgctgcagttgcaagtgtctctgttgcagtcatcgcttctgaaaaaattattaagaaggtatctcatgtttccaatcgttataaagttaaaaagtttgtagacgataaatttgatggaaaccaaaaattattatcgattgtcgatgatttatccgatgatgaattagattctgttttaaatgttgtggatcgtgtgaaagatggcggttcaaaattagctgaatatggcgaaaaagttaaagacaatacagattctttaaaagaacgctttttcacatttattgaagatgcaatgaagttaaaaaagtggcctaggccatcttttttttataaaaataattcttttgtttcaacataa

SEQ ID NO: 290 - protein, 131 aa
MKASTKIGIGLSIAAVASVSVAVIASEKIIKKVSHVSNRYKVKKFVDDKFDGNQKLLSIVDDLSDDELDSVLNVVDRVKDGGSKLAEYGEKVKDNTDSLKERFFTFIEDAMKLKKWPRPSFFYKNNSFVST

SEQ ID NO: 291 - DNA, 314 bp; double-stranded, linear
catcgcttctgaaaaaattattaagaaggtatctcatgtttccaatcgttataaagttaaaaagtttgtagacgataaatttgatggaaaccaaaaattattatcgattgtcgatgatttatccgatgatgaattagattctgttttaaatgttgtggatcgtgtgaaagatggcggttcaaaattagctgaatatggcgaaaaagttaaagacaatacagattctttaaaagaacgctttttcacatttattgaagatgcaatgaagttaaaaaagtggcctaggccatcttttttttataaaaataattctt

SEQ ID NO: 292 - protein, 105 aa
VIASEKIIKKVSHVSNRYKVKKFVDDKFDGNQKLLSIVDDLSDDELDSVLNVVDRVKDGGSKLAEYGEKVKDNTDSLKERFFTFIEDAMKLKKWPRPSFFYKNNS

SEQ ID NO: 293 - DNA, 1839 bp; double-stranded, linear
taatgtaaagtgaatgatgggagagaaaaagagatgaagcatgtaacaaaattggggattacaattataacaggagttttggcattattatttgaatttattttacatcagccgaattgggcgtatggcattattttaataacaggttctgtaatggcgttaatgatgttctgggaaatgattcaaaccttacgtgaaggaaaatatggtgtcgatattttagcgattaccgctatcgttgcaaccttagctgtgggagaatactgggccagtttgatgattttaattatgttgactggtggtgattcattagaagactatgccgctggaaaagctaaccaagagctgaagtcattattggataactcgccacaaaaagctcatcgcttgaatggcgaaaatttagaagatgtttctgttgaggaaatcaatgttggcgatgaattagtagtaaaaccaggggaactagttccagttgatggcttggtaaaaaccgggacatcaacagtcgatgaatcttcattaacaggagaatcaaaaccaattgaaaaaaatcctggggatgaattaatgtcgggttccgtgaatggtgacggctctttgaaaatggttgctgaaaaaactgtagcagacagtcaatatcaaacaattgtgaacttagtgaaagaatctgcggcgcgtccagctcattttgtacgtttagcagatcgctatgcggtaccttttacactagttgcctacctaattgcaggtgttgcttggtttgtttcaaaaagtccgacacgttttgcggaagtcttagttgttgcttcgccgtgtcctttaattctatctgccccaattgctttagtggcagggatgggtcgttcaagtcgtcatggggtcgttattaaatcgggaacgatggtcgaaaaattagcttctgcaaaaacgattgcgtttgataaaacaggcacgattacgcaaggacaactttctgttgatcaagtccaaccaatcaatgctggaataactgctgctgaattagtgggattggcagcaagcgtggaacaagaatcaagtcatattttagctagatcaattgttgcttatgccagaaagcaagatgtcccattaaaaaatattacagatctagcggaagtttctggtgctggcgtgaaggcatttgtggatggtgctgagatacgggtaggtaaaaagaattttgtgacacaagagtctcaagaaactgaaaaaattgataaaacgactattcatatttcacgtaatggcacatatttaggccgaattacttttacagacactgtacgcccagaagcaaaagagactatggaaaaattacaccaattacatcttcaacgaattttaatgctgacgggggatcaagaatccgttgcagaaacgattgctgcagaagtaggaattaccgaagtacatggggaatgtttaccacaagataaattaactattctaaaagaattgcctaaagaaaatcatccagtcatcatggtaggagatggtgtaaatgatgcaccttcgcttgctgctgcagacgtaggtattgctatgggtgctcatggagctactgcggctagtgaaactgctgacgttgttattttaaaagatgacttaagtaaagtcagccaagcggtcgaaattgcccaagataccatgaaaattgccaaacaatctgtattaatcggaatttttatctgcgttttactaatgttaattgctagtaccgggatcattccggcgctaatcggggctatgctacaagaagtcgtggacactgtgtcaatcttatctgctttgcgtgctcgtcgaattggccagtaa

SEQ ID NO: 294 - protein, 601 aa
MKHVTKLGITIITGVLALLFEFILHQPNWAYGIILITGSVMALMMFWEMIQTLREGKYGVDILAITAIVATLAVGEYWASLMILIMLTGGDSLEDYAAGKANQELKSLLDNSPQKAHRLNGENLEDVSVEEINVGDELVVKPGELVPVDGLVKTGTSTVDESSLTGESKPIEKNPGDELMSGSVNGDGSLKMVAEKTVADSQYQTIVNLVKESAARPAHFVRLADRYAVPFTLVAYLIAGVAWFVSKSPTRFAEVLVVASPCPLILSAPIALVAGMGRSSRHGVVIKSGTMVEKLASAKTIAFDKTGTITQGQLSVDQVQPINAGITAAELVGLAASVEQESSHILARSIVAYARKQDVPLKNITDLAEVSGAGVKAFVDGAEIRVGKKNFVTQESQETEKIDKTTIHISRNGTYLGRITFTDTVRPEAKETMEKLHQLHLQRILMLTGDQESVAETIAAEVGITEVHGECLPQDKLTILKELPKENHPVIMVGDGVNDAPSLAAADVGIAMGAHGATAASETADVVILKDDLSKVSQAVEIAQDTMKIAKQSVLIGIFICVLLMLIASTGIIPALIGAMLQEVVDTVSILSALRARRIGQ

SEQ ID NO: 295 - DNA, 1727 bp; double-stranded, linear
tcagccgaattgggcgtatggcattattttaataacaggttctgtaatggcgttaatgatgttctgggaaatgattcaaaccttacgtgaaggaaaatatggtgtcgatattttagcgattaccgctatcgttgcaaccttagctgtgggagaatactgggccagtttgatgattttaattatgttgactggtggtgattcattagaagactatgccgctggaaaagctaaccaagagctgaagtcattattggataactcgccacaaaaagctcatcgcttgaatggcgaaaatttagaagatgtttctgttgaggaaatcaatgttggcgatgaattagtagtaaaaccaggggaactagttccagttgatggcttggtaaaaaccgggacatcaacagtcgatgaatcttcattaacaggagaatcaaaaccaattgaaaaaaatcctggggatgaattaatgtcgggttccgtgaatggtgacggctctttgaaaatggttgctgaaaaaactgtagcagacagtcaatatcaaacaattgtgaacttagtgaaagaatctgcggcgcgtccagctcattttgtacgtttagcagatcgctatgcggtaccttttacactagttgcctacctaattgcaggtgttgcttggtttgtttcaaaaagtccgacacgttttgcggaagtcttagttgttgcttcgccgtgtcctttaattctatctgccccaattgctttagtggcagggatgggtcgttcaagtcgtcatggggtcgttattaaatcgggaacgatggtcgaaaaattagcttctgcaaaaacgattgcgtttgataaaacaggcacgattacgcaaggacaactttctgttgatcaagtccaaccaatcaatgctggaataactgctgctgaattagtgggattggcagcaagcgtggaacaagaatcaagtcatattttagctagatcaattgttgcttatgccagaaagcaagatgtcccattaaaaaatattacagatctagcggaagtttctggtgctggcgtgaaggcatttgtggatggtgctgagatacgggtaggtaaaaagaattttgtgacacaagagtctcaagaaactgaaaaaattgataaaacgactattcatatttcacgtaatggcacatatttaggccgaattacttttacagacactgtacgcccagaagcaaaagagactatggaaaaattacaccaattacatcttcaacgaattttaatgctgacgggggatcaagaatccgttgcagaaacgattgctgcagaagtaggaattaccgaagtacatggggaatgtttaccacaagataaattaactattctaaaagaattgcctaaagaaaatcatccagtcatcatggtaggagatggtgtaaatgatgcaccttcgcttgctgctgcagacgtaggtattgctatgggtgctcatggagctactgcggctagtgaaactgctgacgttgttattttaaaagatgacttaagtaaagtcagccaagcggtcgaaattgcccaagataccatgaaaattgccaaacaatctgtattaatcggaatttttatctgcgttttactaatgttaattgctagtaccgggatcattccggcgctaatcggggctatgctacaagaagtcgtggacactgtgtcaatcttatctgctttgcgtgctcgtcgaattggcc

SEQ ID NO: 296 - protein, 575 aa
QPNWAYGIILITGSVMALMMFWEMIQTLREGKYGVDILAITAIVATLAVGEYWASLMILIMLTGGDSLEDYAAGKANQELKSLLDNSPQKAHRLNGENLEDVSVEEINVGDELVVKPGELVPVDGLVKTGTSTVDESSLTGESKPIEKNPGDELMSGSVNGDGSLKMVAEKTVADSQYQTIVNLVKESAARPAHFVRLADRYAVPFTLVAYLIAGVAWFVSKSPTRFAEVLVVASPCPLILSAPIALVAGMGRSSRHGVVIKSGTMVEKLASAKTIAFDKTGTITQGQLSVDQVQPINAGITAAELVGLAASVEQESSHILARSIVAYARKQDVPLKNITDLAEVSGAGVKAFVDGAEIRVGKKNFVTQESQETEKIDKTTIHISRNGTYLGRITFTDTVRPEAKETMEKLHQLHLQRILMLTGDQESVAETIAAEVGITEVHGECLPQDKLTILKELPKENHPVIMVGDGVNDAPSLAAADVGIAMGAHGATAASETADVVILKDDLSKVSQAVEIAQDTMKIAKQSVLIGIFICVLLMLIASTGIIPALIGAMLQEVVDTVSILSALRARRIG

SEQ ID NO: 297 - DNA, 951 bp; double-stranded, linear
taatttctagcatcaccgaagaaatttttagaaaaacaaagagcctgggccaatcactgtcccaggctctcatgctttatttttaaggaggaagcaatgaagtcaaaaaagaaacgtcgtatcattgatggttttatgattcttttactgattattggaataggtgcatttgcgtatccttttgttagcgatgcattaaataactatctggatcaacaaattatcgctcattatcaagcaaaagcaagccaagaaaacaccaaagaaatggctgaacttcaagaaaaaatggaaaagaaaaaccaagaattagcgaaaaaaggcagcaatcctggattagatcctttttctgaaacgcaaaaaacaacgaaaaaaccagacaaatcctattttgaaagtcatacgattggtgttttaaccattccaaaaataaatgtccgtttaccaatttttgataaaacgaatgcattgctattggaaaaaggaagctccttgttagaaggaacctcctatcctacaggtggtacgaatacacatgcggtcatttcaggccatcgtggtctccctcaagccaaattatttacagatttgccagaattaaaaaaaggcgatgaattttatatcgaagtcaatgggaagacgcttgcttatcaagtagatcaaataaaaaccgttgaaccaactgatacaaaagatttacacattgagtctggccaagatctcgtcactttattaacttgcacaccgtatatgataaacagtcatcggttattagttcgaggacatcgtatcccatatcaaccagaaaaagcagcagcggggatgaaaaaagtggcacaacaacaaaatttactattatggacattacttttaattgcctgtgcgttaattattagcggcttcattatctggtacaagcgacggaaaaagacgaccagaaaaccaaagtag

SEQ ID NO: 298 - protein, 284 aa
MKSKKKRRIIDGFMILLLIIGIGAFAYPFVSDALNNYLDQQIIAHYQAKASQENTKEMAELQEKMEKKNQELAKKGSNPGLDPFSETQKTTKKPDKSYFESHTIGVLTIPKINVRLPIFDKTNALLLEKGSSLLEGTSYPTGGTNTHAVISGHRGLPQAKLFTDLPELKKGDEFYIEVNGKTLAYQVDQIKTVEPTDTKDLHIESGQDLVTLLTCTPYMINSHRLLVRGHRIPYQPEKAAAGMKKVAQQQNLLLWTLLLIACALIISGFIIWYKRRKKTTRKPK

SEQ ID NO: 299 - DNA, 770 bp; double-stranded, linear
tccttttgttagcgatgcattaaataactatctggatcaacaaattatcgctcattatcaagcaaaagcaagccaagaaaacaccaaagaaatggctgaacttcaagaaaaaatggaaaagaaaaaccaagaattagcgaaaaaaggcagcaatcctggattagatcctttttctgaaacgcaaaaaacaacgaaaaaaccagacaaatcctattttgaaagtcatacgattggtgttttaaccattccaaaaataaatgtccgtttaccaatttttgataaaacgaatgcattgctattggaaaaaggaagctccttgttagaaggaacctcctatcctacaggtggtacgaatacacatgcggtcatttcaggccatcgtggtctccctcaagccaaattatttacagatttgccagaattaaaaaaaggcgatgaattttatatcgaagtcaatgggaagacgcttgcttatcaagtagatcaaataaaaaccgttgaaccaactgatacaaaagatttacacattgagtctggccaagatctcgtcactttattaacttgcacaccgtatatgataaacagtcatcggttattagttcgaggacatcgtatcccatatcaaccagaaaaagcagcagcggggatgaaaaaagtggcacaacaacaaaatttactattatggacattacttttaattgcctgtgcgttaattattagcggcttcattatctggtacaagcgacggaaaaagacgaccagaaaaccaa

SEQ ID NO: 300 - protein, 256 aa
PFVSDALNNYLDQQIIAHYQAKASQENTKEMAELQEKMEKKNQELAKKGSNPGLDPFSETQKTTKKPDKSYFESHTIGVLTIPKINVRLPIFDKTNALLLEKGSSLLEGTSYPTGGTNTHAVISGHRGLPQAKLFTDLPELKKGDEFYIEVNGKTLAYQVDQIKTVEPTDTKDLHIESGQDLVTLLTCTPYMINSHRLLVRGHRIPYQPEKAAAGMKKVAQQQNLLLWTLLLIACALIISGFIIWYKRRKKTTRKP

SEQ ID NO: 301 - DNA, 891 bp; double-stranded, linear
tagttacactcgtttagggctagcaacgttaggcattttcgctggactcttagcactctttttattaggaggttatttcctatgaaaaaacgacttttacctatttttttcctaatacttcttacctttggccttgccctacccgtttcggcggctgaaaattcaattgatgatggcgcacaattactgacacctgatcaaatcaaccaactaaagcaagagatacaacctttagaagaaaaaacaaaagcctctgtctttattgtaaccacaaataataatacctatggcgatgaacaagaatatgcagatcattatcttttaaataaagttggcaaggaccaaaatgcgattctttttctcattgatatggacttacggaaaatctacatctctacttctggaaacatgattgattatatgacagatgcacgaattgatgataccttagataaaatatgggataatatgagtcaaggaaattatttcgcggctgctcaaacctttgttcaggaaactcaagcatttgttaataaaggggttcctggggggcactatcgtgtggacagcgaaacaggtaaaatcactcgttataaagtcattaccccgctggaaatggtaattgcttttgctgctgcgctgatactcagtttggtcttcttaggcattaatatttctaaatatcaattaaaattttcaagttatcaatatccctttagggaaaaaacaactttaaacttaacctcccgcacagatcagttaaccaactctttcatcactacgcgtcgtattcctaaaaacaatggcggcagtggcggaatgggcggtggtggtagcaccacccactcaactggcggcggcacattcggtggcggcggtcgaagtttttag

SEQ ID NO: 302 - protein, 269 aa
MKKRLLPIFFLILLTFGLALPVSAAENSIDDGAQLLTPDQINQLKQEIQPLEEKTKASVFIVTTNNNTYGDEQEYADHYLLNKVGKDQNAILFLIDMDLRKIYISTSGNMIDYMTDARIDDTLDKIWDNMSQGNYFAAAQTFVQETQAFVNKGVPGGHYRVDSETGKITRYKVITPLEMVIAFAAALILSLVFLGINISKYQLKFSSYQYPFREKTTLNLTSRTDQLTNSFITTRRIPKNNGGSGGMGGGGSTTHSTGGGTFGGGGRSF

SEQ ID NO: 303 - DNA, 733 bp; double-stranded, linear
ggctgaaaattcaattgatgatggcgcacaattactgacacctgatcaaatcaaccaactaaagcaagagatacaacctttagaagaaaaaacaaaagcctctgtctttattgtaaccacaaataataatacctatggcgatgaacaagaatatgcagatcattatcttttaaataaagttggcaaggaccaaaatgcgattctttttctcattgatatggacttacggaaaatctacatctctacttctggaaacatgattgattatatgacagatgcacgaattgatgataccttagataaaatatgggataatatgagtcaaggaaattatttcgcggctgctcaaacctttgttcaggaaactcaagcatttgttaataaaggggttcctggggggcactatcgtgtggacagcgaaacaggtaaaatcactcgttataaagtcattaccccgctggaaatggtaattgcttttgctgctgcgctgatactcagtttggtcttcttaggcattaatatttctaaatatcaattaaaattttcaagttatcaatatccctttagggaaaaaacaactttaaacttaacctcccgcacagatcagttaaccaactctttcatcactacgcgtcgtattcctaaaaacaatggcggcagtggcggaatgggcggtggtggtagcaccacccactcaactggcggcggcacattcggtggcggcggtcgaagt

SEQ ID NO: 304 - protein, 244 aa
AENSIDDGAQLLTPDQINQLKQEIQPLEEKTKASVFIVTTNNNTYGDEQEYADHYLLNKVGKDQNAILFLIDMDLRKIYISTSGNMIDYMTDARIDDTLDKIWDNMSQGNYFAAAQTFVQETQAFVNKGVPGGHYRVDSETGKITRYKVITPLEMVIAFAAALILSLVFLGINISKYQLKFSSYQYPFREKTTLNLTSRTDQLTNSFITTRRIPKNNGGSGGMGGGGSTTHSTGGGTFGGGGRS

SEQ ID NO: 305 - DNA, 831 bp; double-stranded, linear
tgaatggaacgaagcaatcgtaataaaaaatcttcaaaaaaaccacttattcttggtgtttctgccttggttctaatcgctgctgccggtggcgggtattatgcttatagtcaatggcaagccaaacaagaattagccgaagcgaagaaaacagctactacatttttaaacgtattgtcaaaacaggaatttgataagttaccgtccgttgttcaagaagctagcttaaagaaaaatggctatgatactaaatctgttgttgaaaaataccaagcaatttattcagggattcaagcagaaggagtcaaagctagtgatgttcaagtcaaaaaggcgaaagacaatcaatacacatttacctataaattatcgatgagcacgcctttaggcgaaatgaaagatttgtcttatcaatcaagtatcgccaaaaaaggcgatacctaccaaatcgcttggaagccatctttaatttttccagatatgtcaggaaatgataaaatttcgattcaagtagataatgccaaacgtggagaaattgtcgatcgtaatggtagtgggctagcaattaacaaagtgtttgacgaagtgggcgtagtgcctggcaaactcggttctggcgcagaaaaaacagccaatatcaaagcttttagtgataaattcggcgtttctgttgatgaaatcaatcaaaagttaagccaaggatgggtccaagcagactcctttgtaccaatcacagtcgcttctgaaccagtgacagaattaccaacaggggctgcgacaaaagatacagagtcacgttattatccgctgggggaagcantgcgcaattaa

SEQ ID NO: 306 - protein, 275 aa
MERSNRNKKSSKKPLILGVSALVLIAAAGGGYYAYSQWQAKQELAEAKKTATTFLNVLSKQEFDKLPSVVQEASLKKNGYDTKSVVEKYQAIYSGIQAEGVKASDVQVKKAKDNQYTFTYKLSMSTPLGEMKDLSYQSSIAKKGDTYQIAWKPSLIFPDMSGNDKISIQVDNAKRGEIVDRNGSGLAINKVFDEVGVVPGKLGSGAEKTANIKAFSDKFGVSVDEINQKLSQGWVQADSFVPITVASEPVTELPTGAATKDTESRYYPLGEAXRN

SEQ ID NO: 307 - DNA, 725 bp; double-stranded, linear
tggcgggtattatgcttatagtcaatggcaagccaaacaagaattagccgaagcgaagaaaacagctactacatttttaaacgtattgtcaaaacaggaatttgataagttaccgtccgttgttcaagaagctagcttaaagaaaaatggctatgatactaaatctgttgttgaaaaataccaagcaatttattcagggattcaagcagaaggagtcaaagctagtgatgttcaagtcaaaaaggcgaaagacaatcaatacacatttacctataaattatcgatgagcacgcctttaggcgaaatgaaagatttgtcttatcaatcaagtatcgccaaaaaaggcgatacctaccaaatcgcttggaagccatctttaatttttccagatatgtcaggaaatgataaaatttcgattcaagtagataatgccaaacgtggagaaattgtcgatcgtaatggtagtgggctagcaattaacaaagtgtttgacgaagtgggcgtagtgcctggcaaactcggttctggcgcagaaaaaacagccaatatcaaagcttttagtgataaattcggcgtttctgttgatgaaatcaatcaaaagttaagccaaggatgggtccaagcagactcctttgtaccaatcacagtcgcttctgaaccagtgacagaattaccaacaggggctgcgacaaaagatacagagtcacgttattatccgctggggg

SEQ ID NO: 308 - protein, 241 aa
GGYYAYSQWQAKQELAEAKKTATTFLNVLSKQEFDKLPSVVQEASLKKNGYDTKSVVEKYQAIYSGIQAEGVKASDVQVKKAKDNQYTFTYKLSMSTPLGEMKDLSYQSSIAKKGDTYQIAWKPSLIFPDMSGNDKISIQVDNAKRGEIVDRNGSGLAINKVFDEVGVVPGKLGSGAEKTANIKAFSDKFGVSVDEINQKLSQGWVQADSFVPITVASEPVTELPTGAATKDTESRYYPLG

SEQ ID NO: 309 - DNA, 744 bp; double-stranded, linear
taaaaaatgaaaaagatcgtgcgcatttcaagcattttgttcgttgctacgcctcttatgcttttaaatagttcaaaagttgaagcagctcaagtcgcttctattcaatccaacgctgatattacgtttgctcttgataatactgtcacgccacctgtcaacccgacgaacccttctcagcctgtgacacctaatcctgctgatcctcatcaacctggtacagccggaccccttagtattgactatgtttcaaatatccattttggatcaaaacaaattcaagccggaacagcgatctattcggcacaactggatcaagtgcaaaatagtactggcgatttaattagcgtgccaaactatgttcaagtaactgacaaacgtggtctaaatcttggctggaaattatcagttaaacagagtgcgcaatttgctacaagtgattcaacacccgctgttttggataatgcatccttgacctttttagcagcaacacccaattcaacacagttactttctttggcgccattaacggtcccagtaaccttggatccaactggtgccgccacttctcctgtggcgactgccgctctttcaacaggaatgggcacttggacattagcttttggtagcggancgaccgctgctcaaggcattcaattaactgttcctgcgacaacgaaaaaagttgcagctaaacaatataaaacaacgcttacttggattttggatgatacaccactttaa

SEQ ID NO: 310 - protein, 245 aa
MKKIVRISSILFVATPLMLLNSSKVEAAQVASIQSNADITFALDNTVTPPVNPTNPSQPVTPNPADPHQPGTAGPLSIDYVSNIHFGSKQIQAGTAIYSAQLDQVQNSTGDLISVPNYVQVTDKRGLNLGWKLSVKQSAQFATSDSTPAVLDNASLTFLAATPNSTQLLSLAPLTVPVTLDPTGAATSPVATAALSTGMGTWTLAFGSGXTAAQGIQLTVPATTKKVAAKQYKTTLTWILDDTPL

SEQ ID NO: 311 - DNA, 654 bp; double-stranded, linear
agctcaagtcgcttctattcaatccaacgctgatattacgtttgctcttgataatactgtcacgccacctgtcaacccgacgaacccttctcagcctgtgacacctaatcctgctgatcctcatcaacctggtacagccggaccccttagtattgactatgtttcaaatatccattttggatcaaaacaaattcaagccggaacagcgatctattcggcacaactggatcaagtgcaaaatagtactggcgatttaattagcgtgccaaactatgttcaagtaactgacaaacgtggtctaaatcttggctggaaattatcagttaaacagagtgcgcaatttgctacaagtgattcaacacccgctgttttggataatgcatccttgacctttttagcagcaacacccaattcaacacagttactttctttggcgccattaacggtcccagtaaccttggatccaactggtgccgccacttctcctgtggcgactgccgctctttcaacaggaatgggcacttggacattagcttttggtagcggancgaccgctgctcaaggcattcaattaactgttcctgcgacaacgaaaaaagttgcagctaaacaatataaaacaacgcttacttggattttggatgatacaccact

SEQ ID NO: 312 - protein, 217 aa
AQVASIQSNADITFALDNTVTPPVNPTNPSQPVTPNPADPHQPGTAGPLSIDYVSNIHFGSKQIQAGTAIYSAQLDQVQNSTGDLISVPNYVQVTDKRGLNLGWKLSVKQSAQFATSDSTPAVLDNASLTFLAATPNSTQLLSLAPLTVPVTLDPTGAATSPVATAALSTGMGTWTLAFGSGXTAAQGIQLTVPATTKKVAAKQYKTTLTWILDDTP

SEQ ID NO: 313 - DNA, 1329 bp; double-stranded, linear
taatttaaaagacaaggagaaataaaaatgaaaaagaaaattttagcaggagcgcttgtcgctctgttttttatgcctacagctatgtttgccgcaaaaggagaccaaggtgtggattgggcgatttatcaaggtgaacaaggtcgctttggctatgcacatgataaattcgctattgcccagattggaggctacaatgctagcggtatttatgaacaatacacatataaaacgcaagtggcaagtgctattgcccaaggtaaacgtgcgcatacctatatttggtatgacacttggggaaacatggacattgcgaaaacaacaatggattactttttgccacgtattcaaacgcctaaaaattccatcgttgcattagattttgaacatggagcgttggctagtgttccagatggatatggaggatatgtaagttcagatgccgaaaaagcagcaaatacagagacaattttgtacggtatgcgcagaatcaaacaggctggctatactccaatgtattacagctataagccatttacactaaatcatgtaaactatcaacaaatcatcaaagagtttcctaactctttatggattgctgcgtatcctatcgatggtgtgtcaccatatccattgtatgcttatttcccaagcatggatggtattggtatttggcaattcacatccgcttatattgcaggtggtttagatggtaacgtagatttaacaggaattacggatagtggttatacagataccaataaaccagaaacggatacgccagcaacagatgcaggcgaagaaattgaaaaaatacctaattctgatgttaaagttggcgataccgtcaaagtgaaatttaatgtagatgcttgggcaactggggaagctattccgcaatgggtaaaaggaaacagctacaaagtgcaagaagtaactggaagcagagtattgcttgaaggtatcttgtcatggattagcaaaggtgatattgaattattgccagacgcaacagtcgtccctgataagcaaccagaagcgactcatgtggtacaatacggagaaacattatcaagtattgcttatcaatatggaacagactatcaaacgttggcggcattaaatggattggctaatccaaatcttatttatcctggtcaagttttgaaagtcaatggatcggcaacaagtaatgtctacacggttaaatacggcgataatttatctagtattgcagcaaaacttggcactacttatcaagctttagctgcattaaacggattagcaaatcctaacttgatttatccaggtcaaacattgaattattaa

SEQ ID NO: 314 - protein, 433 aa
MKKKILAGALVALFFMPTAMFAAKGDQGVDWAIYQGEQGRFGYAHDKFAIAQIGGYNASGIYEQYTYKTQVASAIAQGKRAHTYIWYDTWGNMDIAKTTMDYFLPRIQTPKNSIVALDFEHGALASVPDGYGGYVSSDAEKAANTETILYGMRRIKQAGYTPMYYSYKPFTLNHVNYQQIIKEFPNSLWIAAYPIDGVSPYPLYAYFPSMDGIGIWQFTSAYIAGGLDGNVDLTGITDSGYTDTNKPETDTPATDAGEEIEKIPNSDVKVGDTVKVKFNVDAWATGEAIPQWVKGNSYKVQEVTGSRVLLEGILSWISKGDIELLPDATVVPDKQPEATHVVQYGETLSSIAYQYGTDYQTLAALNGLANPNLIYPGQVLKVNGSATSNVYTVKYGDNLSSIAAKLGTTYQALAALNGLANPNLIYPGQTLNY

SEQ ID NO: 315 - DNA, 1228 bp; double-stranded, linear
aaaaggagaccaaggtgtggattgggcgatttatcaaggtgaacaaggtcgctttggctatgcacatgataaattcgctattgcccagattggaggctacaatgctagcggtatttatgaacaatacacatataaaacgcaagtggcaagtgctattgcccaaggtaaacgtgcgcatacctatatttggtatgacacttggggaaacatggacattgcgaaaacaacaatggattactttttgccacgtattcaaacgcctaaaaattccatcgttgcattagattttgaacatggagcgttggctagtgttccagatggatatggaggatatgtaagttcagatgccgaaaaagcagcaaatacagagacaattttgtacggtatgcgcagaatcaaacaggctggctatactccaatgtattacagctataagccatttacactaaatcatgtaaactatcaacaaatcatcaaagagtttcctaactctttatggattgctgcgtatcctatcgatggtgtgtcaccatatccattgtatgcttatttcccaagcatggatggtattggtatttggcaattcacatccgcttatattgcaggtggtttagatggtaacgtagatttaacaggaattacggatagtggttatacagataccaataaaccagaaacggatacgccagcaacagatgcaggcgaagaaattgaaaaaatacctaattctgatgttaaagttggcgataccgtcaaagtgaaatttaatgtagatgcttgggcaactggggaagctattccgcaatgggtaaaaggaaacagctacaaagtgcaagaagtaactggaagcagagtattgcttgaaggtatcttgtcatggattagcaaaggtgatattgaattattgccagacgcaacagtcgtccctgataagcaaccagaagcgactcatgtggtacaatacggagaaacattatcaagtattgcttatcaatatggaacagactatcaaacgttggcggcattaaatggattggctaatccaaatcttatttatcctggtcaagttttgaaagtcaatggatcggcaacaagtaatgtctacacggttaaatacggcgataatttatctagtattgcagcaaaacttggcactacttatcaagctttagctgcattaaacggattagcaaatcctaacttgatttatccaggtcaaacattgaat

SEQ ID NO: 316 - protein, 409 aa
KGDQGVDWAIYQGEQGRFGYAHDKFAIAQIGGYNASGIYEQYTYKTQVASAIAQGKRAHTYIWYDTWGNMDIAKTTMDYFLPRIQTPKNSIVALDFEHGALASVPDGYGGYVSSDAEKAANTETILYGMRRIKQAGYTPMYYSYKPFTLNHVNYQQIIKEFPNSLWIAAYPIDGVSPYPLYAYFPSMDGIGIWQFTSAYIAGGLDGNVDLTGITDSGYTDTNKPETDTPATDAGEEIEKIPNSDVKVGDTVKVKFNVDAWATGEAIPQWVKGNSYKVQEVTGSRVLLEGILSWISKGDIELLPDATVVPDKQPEATHVVQYGETLSSIAYQYGTDYQTLAALNGLANPNLIYPGQVLKVNGSATSNVYTVKYGDNLSSIAAKLGTTYQALAALNGLANPNLIYPGQTLN

SEQ ID NO: 317 - DNA, 1245 bp; double-stranded, linear
tagtcaaacgtttattttttccttaaatccagaaaaaatcccgtaattatggtacactacctattgaattggaggagaactatgaagaaatttgatgtaattattgtcggtgctgggacgagcggtatgatggccacgattgcggccgccgaagcaggcgctcaagtattattgattgaaaaaaatcgccgtgttgggaaaaaattattaatgactggtggcggccgctgtaatgtaaccaataatcggcccgcagaagaaatcatttcatttattcctgggaatggaaaatttttatacagcgcattttcacaatttgataactatgatatcatgaacttttttgaatccaatggtattcacttaaaagaagaagatcacggacgcatgttccctgttacagataaatcgaagtcaattgttgatgcgctatttaaccgcattaacgaattaggagtcactgtttttacaaaaacacaggtcacaaaattactacgaaaagacgatcaaataattggcgttgaaaccgaactggaaaaaatttatgcaccgtgtgttgtattaacaactggcggccgcacttatccttccacaggagcaactggtgatggctataaactagccaaaaaaatggggcataccatcagcccgctctaccctaccgaatcacctattatttctgaagaaccttttatcctggataaaacgttgcaaggtctctctttacaagatgttaatttaactgttttgaaccaaaaaggaaaacctttagttaatcatcaaatggatatgctgtttacacattttggcatttcaggacctgccgcgctccgctgttctagttttattaaccaagaattaactcgcaacggtaatcaacctgtcacggtagccttggatgtgtttccgacaaaatcttttgaagaagtgcctgccaaacaactaacagaaaagcaacgnctttcctttgtggaactactgaaagactttcagttcactgttacgaaaacattgcctttggaaaaatcttttgtcacaggcggtgggatttccctcaaagaagtgacccctaaaacaatggagagcaaattagtcaatggtttattttttgctggtgaacttttagatattaatggctatactggaggctacaatgttacagctgcatttgtcactggacatgttgctggctcccatgccgcagaaattgcagaatacacctatttaccaattgaagaagtctaa

SEQ ID NO: 318 - protein, 387 aa
MKKFDVIIVGAGTSGMMATIAAAEAGAQVLLIEKNRRVGKKLLMTGGGRCNVTNNRPAEEIISFIPGNGKFLYSAFSQFDNYDIMNFFESNGIHLKEEDHGRMFPVTDKSKSIVDALFNRINELGVTVFTKTQVTKLLRKDDQIIGVETELEKIYAPCVVLTTGGRTYPSTGATGDGYKLAKKMGHTISPLYPTESPIISEEPFILDKTLQGLSLQDVNLTVLNQKGKPLVNHQMDMLFTHFGISGPAALRCSSFINQELTRNGNQPVTVALDVFPTKSFEEVPAKQLTEKQRLSFVELLKDFQFTVTKTLPLEKSFVTGGGISLKEVTPKTMESKLVNGLFFAGELLDINGYTGGYNVTAAFVTGHVAGSHAAEIAEYTYLPIEEV

SEQ ID NO: 319 - DNA, 1093 bp; double-stranded, linear
cgaagcaggcgctcaagtattattgattgaaaaaaatcgccgtgttgggaaaaaattattaatgactggtggcggccgctgtaatgtaaccaataatcggcccgcagaagaaatcatttcatttattcctgggaatggaaaatttttatacagcgcattttcacaatttgataactatgatatcatgaacttttttgaatccaatggtattcacttaaaagaagaagatcacggacgcatgttccctgttacagataaatcgaagtcaattgttgatgcgctatttaaccgcattaacgaattaggagtcactgtttttacaaaaacacaggtcacaaaattactacgaaaagacgatcaaataattggcgttgaaaccgaactggaaaaaatttatgcaccgtgtgttgtattaacaactggcggccgcacttatccttccacaggagcaactggtgatggctataaactagccaaaaaaatggggcataccatcagcccgctctaccctaccgaatcacctattatttctgaagaaccttttatcctggataaaacgttgcaaggtctctctttacaagatgttaatttaactgttttgaaccaaaaaggaaaacctttagttaatcatcaaatggatatgctgtttacacattttggcatttcaggacctgccgcgctccgctgttctagttttattaaccaagaattaactcgcaacggtaatcaacctgtcacggtagccttggatgtgtttccgacaaaatcttttgaagaagtgcctgccaaacaactaacagaaaagcaacgnctttcctttgtggaactactgaaagactttcagttcactgttacgaaaacattgcctttggaaaaatcttttgtcacaggcggtgggatttccctcaaagaagtgacccctaaaacaatggagagcaaattagtcaatggtttattttttgctggtgaacttttagatattaatggctatactggaggctacaatgttacagctgcatttgtcactggacatgttgctggctcccatgccgcagaaattgcagaatacacctatttaccaattgaagaagtc

SEQ ID NO: 320 - protein, 364 aa
EAGAQVLLIEKNRRVGKKLLMTGGGRCNVTNNRPAEEIISFIPGNGKFLYSAFSQFDNYDIMNFFESNGIHLKEEDHGRMFPVTDKSKSIVDALFNRINELGVTVFTKTQVTKLLRKDDQIIGVETELEKIYAPCVVLTTGGRTYPSTGATGDGYKLAKKMGHTISPLYPTESPIISEEPFILDKTLQGLSLQDVNLTVLNQKGKPLVNHQMDMLFTHFGISGPAALRCSSFINQELTRNGNQPVTVALDVFPTKSFEEVPAKQLTEKQRLSFVELLKDFQFTVTKTLPLEKSFVTGGGISLKEVTPKTMESKLVNGLFFAGELLDINGYTGGYNVTAAFVTGHVAGSHAAEIAEYTYLPIEEV

SEQ ID NO: 321 - DNA, 1509 bp; double-stranded, linear
taacccatgaaatcattttgtcccgcatatggggatatgactttgacggtgatggcagcacagtccacactcatatcaaaaatctgcgggcgaactgccggaaaatatcatcaaaaccatccgcggtgtaggttaccgattggaggaatcattataatggaaagaaaagggattttcattaaggttttttcctatacgatcattgtcctgttactgcttgtcggtgtaacggcaacactgtttgcacagcaatttgtgtcttatttcagagcgatggaagcacagcaaacagtaaaatcctatcagccattggtggaactgattcagaatagcgataggcttgatatgcaagaggtggcagggctgtttcactacaataaccaatcctttgagttttatattgaagataaagagggaagcgtactctatgccacaccgaatgccgatacatcaaatagtgttaggcccgactttctttatgtggtacatagagatgataatatttcgattgttgctcaaagcaaggcaggtgtgggattgctttatcaagggctgacaattcggggaattgttatgattgcgataatggttgtattcagccttttatgcgcgtatatctttgcgcggcaaatgacaacgccgatcaaagccttagcggacagtgcgaataaaatggcaaacctgaaagaagtaccgccgccgctggagcgaaaggatgagcttggcgcactggctcacgacatgcattccatgtatatcaggctgaaagaaaccatcgcaaggctggaggatgaaatcgcaagggaacatgagttggaggaaacacagcgatatttctttgcggcagcctctcatgagttaaaaacgcccatcgcggctgtaagcgttctgttggagggaatgcttgaaaatatcggtgactacaaagaccattctaagtatctgcgcgaatgcatcaaaatgatggacaggcagggcaaaaccatttccgaaatactggagcttgtcagcctgaacgatgggagaatcgtacccatagccgaaccgctggacatagggcgcacggttgccgagctgctacccgattttcaaaccttggcagaggcaaacaaccagcggttcgtcacagatattccagccggacaaattgtcctgtccgatccgaagctgatccaaaaggcgctatccaatgtcatattgaatgcggttcagaacacgccccagggaggtgaggtacggatatggagtgagcctggggctgaaaaataccgtctttccgttttgaacatgggcgttcacattgatgatactgcactttcaaagctgttcatcccattctatcgcattgatcaggcgcgaagcagcaaaaagtgggcgaagcggtttggggcttgccatcgtacaaaaaacgctggatgccatgagcctccaatatgcgctggaaaacacctcagatggcgttttgttctggctggatttaccgcccacatcaacactataaatatttaa

SEQ ID NO: 322 - protein, 450 aa
MERKGIFIKVFSYTIIVLLLLVGVTATLFAQQFVSYFRAMEAQQTVKSYQPLVELIQNSDRLDMQEVAGLFHYNNQSFEFYIEDKEGSVLYATPNADTSNSVRPDFLYVVHRDDNISIVAQSKAGVGLLYQGLTIRGIVMIAIMVVFSLLCAYIFARQMTTPIKALADSANKMANLKEVPPPLERKDELGALAHDMHSMYIRLKETIARLEDEIAREHELEETQRYFFAAASHELKTPIAAVSVLLEGMLENIGDYKDHSKYLRECIKMMDRQGKTISEILELVSLNDGRIVPIAEPLDIGRTVAELLPDFQTLAEANNQRFVTDIPAGQIVLSDPKLIQKALSNVILNAVQNTPQGGEVRIWSEPGAEKYRLSVLNMGVHIDDTALSKLFIPFYRIDQARSSKKWAKRFGACHRTKNAGCHEPPICAGKHLRWRFVLAGFTAHINTINI

SEQ ID NO: 323 - DNA, 1259 bp; double-stranded, linear
gcaatttgtgtcttatttcagagcgatggaagcacagcaaacagtaaaatcctatcagccattggtggaactgattcagaatagcgataggcttgatatgcaagaggtggcagggctgtttcactacaataaccaatcctttgagttttatattgaagataaagagggaagcgtactctatgccacaccgaatgccgatacatcaaatagtgttaggcccgactttctttatgtggtacatagagatgataatatttcgattgttgctcaaagcaaggcaggtgtgggattgctttatcaagggctgacaattcggggaattgttatgattgcgataatggttgtattcagccttttatgcgcgtatatctttgcgcggcaaatgacaacgccgatcaaagccttagcggacagtgcgaataaaatggcaaacctgaaagaagtaccgccgccgctggagcgaaaggatgagcttggcgcactggctcacgacatgcattccatgtatatcaggctgaaagaaaccatcgcaaggctggaggatgaaatcgcaagggaacatgagttggaggaaacacagcgatatttctttgcggcagcctctcatgagttaaaaacgcccatcgcggctgtaagcgttctgttggagggaatgcttgaaaatatcggtgactacaaagaccattctaagtatctgcgcgaatgcatcaaaatgatggacaggcagggcaaaaccatttccgaaatactggagcttgtcagcctgaacgatgggagaatcgtacccatagccgaaccgctggacatagggcgcacggttgccgagctgctacccgattttcaaaccttggcagaggcaaacaaccagcggttcgtcacagatattccagccggacaaattgtcctgtccgatccgaagctgatccaaaaggcgctatccaatgtcatattgaatgcggttcagaacacgccccagggaggtgaggtacggatatggagtgagcctggggctgaaaaataccgtctttccgttttgaacatgggcgttcacattgatgatactgcactttcaaagctgttcatcccattctatcgcattgatcaggcgcgaagcagcaaaaagtgggcgaagcggtttggggcttgccatcgtacaaaaaacgctggatgccatgagcctccaatatgcgctggaaaacacctcagatggcgttttgttctggctggatttaccgcccacatcaacactataaatattt

SEQ ID NO: 324 - protein, 419 aa
QFVSYFRAMEAQQTVKSYQPLVELIQNSDRLDMQEVAGLFHYNNQSFEFYIEDKEGSVLYATPNADTSNSVRPDFLYVVHRDDNISIVAQSKAGVGLLYQGLTIRGIVMIAIMVVFSLLCAYIFARQMTTPIKALADSANKMANLKEVPPPLERKDELGALAHDMHSMYIRLKETIARLEDEIAREHELEETQRYFFAAASHELKTPIAAVSVLLEGMLENIGDYKDHSKYLRECIKMMDRQGKTISEILELVSLNDGRIVPIAEPLDIGRTVAELLPDFQTLAEANNQRFVTDIPAGQIVLSDPKLIQKALSNVILNAVQNTPQGGEVRIWSEPGAEKYRLSVLNMGVHIDDTALSKLFIPFYRIDQARSSKKWAKRFGACHRTKNAGCHEPPICAGKHLRWRFVLAGFTAHINTINI

SEQ ID NO: 325 - DNA, 2559 bp; double-stranded, linear
taactggtgggattggcaaattggttccgcgcagcgctaacagatacattgattttattacatgatgacctattgaatacagatgcagaaaaattaaataaatttactgctccgctgatgctgtatgcaaaagatccaaacatacaatggccaatttatcgtgcaacaggagctaacttaacagatatttcaatcaccgttttaggtactggacttttgttagaagataatcaacgcctagtacaagtacaagaagctgttccgtccgttttaaaaagtgtttcctctggtgatggcttatatcctgatggttccttgattcaacatggttattttccgtacaacggcagttacgggaatgagttgctaaaagggtttggacgaattcagactattttacaaggttccgactgggagatgaatgaccctaacattagtaatttatttaatgttgtggataaaggttacttacaattgatggtaaatggaaaaatgccatcgatggtttctggtagaagtatttccagagcgccagaaacgaatccttttactacagagtttgaatcgggtaaagaaacaatagctaatttaaccttaattgcaaaatttgcaccagaaaatttaagaaatgacatttatacatctatccaaacgtggcttcaacaaagtgggtcatactatcatttctttaaaaaaccaagagattttgaagcgttaattgacttgaaaaatgtagtgaatagtgcgtcacctgcccaagcgacaccaatgcaatctttaaatgtatatggttcgatggatcgagtcctacagaaaaataacgaatatgcggtggggatcagtatgtattcacaacgtgtcggaaactatgaatttgggaatacggaaaataaaaaaggctggcatacagcagacggcatgctttatttatacaatcaagactttgctcagtttgatgaaggatactgggcaacgatcgatccatatcgattaccaggaacgacagttgacacaagagaattggcaaatggtgcttatacagggaaacgcagtccccagtcatgggtaggtggctcaaataatggacaggttgcctctataggaatgtttttagataaaagtaatgaaggaatgaacttagttgctaaaaaatcttggttcttattagatggtcaaatcattaatttgggaagtggcattactggtacgacagatgcttcgattgaaacaatcctcgataatcggatgattcatccacaggaagtgaagcttaaccaaggttcagacaaagataattcttggattagtttaagcgcagcgantccattgaataacattggctatgtttttcctaattcnatgaatacgcttgatgttcaaatagaagaacgctctggtcgctacggagatattaacgaatactttgttaatgataaaacctatacaaatacatttgctaaaattagtaaaaattatggcaagactgttgaaaatggtacttacgaatatttaacagtggttgggaaaacgaatgaagaaatcgcagctctttctaaaaacaaaggctatactgttctagaaaatacagcaaacttacaagccattgaagcaggtaattatgtcatgatgaatacatggaataatgaccaagaaattgcaggactgtatgcgtatgatccaatgtcggttatttcagaaaaaattgataacggtgtttatcgcttaactcttgcgaatcctttacaaaataatgcatccgtttctattgaatttgataagggcattcttgaagtagtcgcagcggacccagaaatttctgttgaccaaaatattatcactttaaatagtgcggggttaaatggcagctcgcgttcaatcattgttaaaacaactcctgaagtaacgaaagaagcgttagaaaaattaattcaggaacaaaaagaacaccaagaaaaagactacaccgcaagcagctggaaagtctacagcgaagcattgaaacaagcacaaactgtggcagatcaaacaacagcaacgcaagcagaagtagaccaagcagaaacagagttacgttcggcagtgaagcaattggtaaaagtgccaactaaagaagtagataaaaccaacttgttgaaaatcatcaaagaaaacgagaaacaccaagaaaaagactacaccgcaagcagttggaaagtctacagtgaagcattgaagcaagcgcaaactgtggcagatcaaacaacagcaacgcaagcagaagtagaccaagcagaagcaaaactacgttcggcagtgaagcgattaacattgaaaaatagtggggaaaataaaaaggagcaaaaaaatggggggaataatggacacttaaatactagtacaggagttgatcaaactggtacgaaacaagttaagccatcaagccaaggtggtttcagaaaagctagccaatttttaccgagcacaggagaaaagaaatcgatcgcgcttgtgattattggtcttctagttatcgccagtgggtgtcttttagtttttcgtaaaagtaaatcgaagaagtaa

SEQ ID NO: 326 - protein, 851 aa
LVGLANWFRAALTDTLILLHDDLLNTDAEKLNKFTAPLMLYAKDPNIQWPIYRATGANLTDISITVLGTGLLLEDNQRLVQVQEAVPSVLKSVSSGDGLYPDGSLIQHGYFPYNGSYGNELLKGFGRIQTILQGSDWEMNDPNISNLFNVVDKGYLQLMVNGKMPSMVSGRSISRAPETNPFTTEFESGKETIANLTLIAKFAPENLRNDIYTSIQTWLQQSGSYYHFFKKPRDFEALIDLKNVVNSASPAQATPMQSLNVYGSMDRVLQKNNEYAVGISMYSQRVGNYEFGNTENKKGWHTADGMLYLYNQDFAQFDEGYWATIDPYRLPGTTVDTRELANGAYTGKRSPQSWVGGSNNGQVASIGMFLDKSNEGMNLVAKKSWFLLDGQIINLGSGITGTTDASIETILDNRMIHPQEVKLNQGSDKDNSWISLSAAXPLNNIGYVFPNSMNTLDVQIEERSGRYGDINEYFVNDKTYTNTFAKISKNYGKTVENGTYEYLTVVGKTNEEIAALSKNKGYTVLENTANLQAIEAGNYVMMNTWNNDQEIAGLYAYDPMSVISEKIDNGVYRLTLANPLQNNASVSIEFDKGILEVVAADPEISVDQNIITLNSAGLNGSSRSIIVKTTPEVTKEALEKLIQEQKEHQEKDYTASSWKVYSEALKQAQTVADQTTATQAEVDQAETELRSAVKQLVKVPTKEVDKTNLLKIIKENEKHQEKDYTASSWKVYSEALKQAQTVADQTTATQAEVDQAEAKLRSAVKRLTLKNSGENKKEQKNGGNNGHLNTSTGVDQTGTKQVKPSSQGGFRKASQFLPSTGEKKSIALVIIGLLVIASGCLLVFRKSKSKK

SEQ ID NO: 327 - DNA, 472 bp; double-stranded, linear
accagaaaatttaagaaatgacatttatacatctatccaaacgtggcttcaacaaagtgggtcatactatcatttctttaaaaaaccaagagattttgaagcgttaattgacttgaaaaatgtagtgaatagtgcgtcacctgcccaagcgacaccaatgcaatctttaaatgtatatggttcgatggatcgagtcctacagaaaaataacgaatatgcggtggggatcagtatgtattcacaacgtgtcggaaactatgaatttgggaatacggaaaataaaaaaggctggcatacagcagacggcatgctttatttatacaatcaagactttgctcagtttgatgaaggatactgggcaacgatcgatccatatcgattaccaggaacgacagttgacacaagagaattggcaaatggtgcttatacagggaaacgcagtccccagtcatgggtaggtggctcaaataat

SEQ ID NO: 328 - protein, 157 aa
PENLRNDIYTSIQTWLQQSGSYYHFFKKPRDFEALIDLKNVVNSASPAQATPMQSLNVYGSMDRVLQKNNEYAVGISMYSQRVGNYEFGNTENKKGWHTADGMLYLYNQDFAQFDEGYWATIDPYRLPGTTVDTRELANGAYTGKRSPQSWVGGSNN

SEQ ID NO: 329 - DNA, 2559 bp; double-stranded, linear; identical to SEQ ID NO: 325

SEQ ID NO: 330 - protein, 851 aa; identical to SEQ ID NO: 326

SEQ ID NO: 331 - DNA, 519 bp; double-stranded, linear
aatcggatgattcatccacaggaagtgaagcttaaccaaggttcagacaaagataattcttggattagtttaagcgcagcgantccattgaataacattggctatgtttttcctaattcnatgaatacgcttgatgttcaaatagaagaacgctctggtcgctacggagatattaacgaatactttgttaatgataaaacctatacaaatacatttgctaaaattagtaaaaattatggcaagactgttgaaaatggtacttacgaatatttaacagtggttgggaaaacgaatgaagaaatcgcagctctttctaaaaacaaaggctatactgttctagaaaatacagcaaacttacaagccattgaagcaggtaattatgtcatgatgaatacatggaataatgaccaagaaattgcaggactgtatgcgtatgatccaatgtcggttatttcagaaaaaattgataacggtgtttatcgcttaactcttgcgaatcctttacaaaataatgcatcc

SEQ ID NO: 332 - protein, 173 aa
NRMIHPQEVKLNQGSDKDNSWISLSAAXPLNNIGYVFPNSMNTLDVQIEERSGRYGDINEYFVNDKTYTNTFAKISKNYGKTVENGTYEYLTVVGKTNEEIAALSKNKGYTVLENTANLQAIEAGNYVMMNTWNNDQEIAGLYAYDPMSVISEKIDNGVYRLTLANPLQNNAS

SEQ ID NO: 333 - DNA, 2559 bp; double-stranded, linear; identical to SEQ ID NO: 325

SEQ ID NO: 334 - protein, 851 aa; identical to SEQ ID NO: 326

SEQ ID NO: 335 - DNA, 586 bp; double-stranded, linear
aactcctgaagtaacgaaagaagcgttagaaaaattaattcaggaacaaaaagaacaccaagaaaaagactacaccgcaagcagctggaaagtctacagcgaagcattgaaacaagcacaaactgtggcagatcaaacaacagcaacgcaagcagaagtagaccaagcagaaacagagttacgttcggcagtgaagcaattggtaaaagtgccaactaaagaagtagataaaaccaacttgttgaaaatcatcaaagaaaacgagaaacaccaagaaaaagactacaccgcaagcagttggaaagtctacagtgaagcattgaagcaagcgcaaactgtggcagatcaaacaacagcaacgcaagcagaagtagaccaagcagaagcaaaactacgttcggcagtgaagcgattaacattgaaaaatagtggggaaaataaaaaggagcaaaaaaatggggggaataatggacacttaaatactagtacaggagttgatcaaactggtacgaaacaagttaagccatcaagccaaggtggtttcagaaaagctagccaatttttaccgagcacaggagaaaagaaa

SEQ ID NO: 336 - protein, 195 aa
TPEVTKEALEKLIQEQKEHQEKDYTASSWKVYSEALKQAQTVADQTTATQAEVDQAETELRSAVKQLVKVPTKEVDKTNLLKIIKENEKHQEKDYTASSWKVYSEALKQAQTVADQTTATQAEVDQAEAKLRSAVKRLTLKNSGENKKEQKNGGNNGHLNTSTGVDQTGTKQVKPSSQGGFRKASQFLPSTGEKK

SEQ ID NO: 337 - DNA, 1221 bp; double-stranded, linear
tgacagatacacctgctaacacaggaaactaagaacgacagcatacacgcaagatcgggatataggtcaaaaattttttggcttatctttcggtcttttggtgcttataatacaacaaagaatgacagacataggagaatgaatatgaacagatggaaagtatatgcaacggtaatcgcttgtatgttatttggctggattggcgtggaggcgcacgcttctgaatttaattttgcggtcacaccaacaattcccgaaaatcaagtggataaatcaaaaacctactttgacttaaaaatggcgcctggtgccaaacaaaccgtagaaattcagttacgcaatgatacagatgaagacattaccattgaaaatacggtgaactcagcgacaacaaatttaaatggcgtagtagaatatggccaaaacgggatcaaacctgacaaaaccttacgttttaacttaaaagattatgtggaagcaccgaaagaaatcatcttgccgaagcattcccaaaagaccttacctttaaccattacgatgcctaaagattcttttgatggcgtgatggctggcggtataacactcaaagagaaaaagaaagaaacaacgacttctgcggatcaatcaaaagggttagctattaataatgaatactcctatgttgtggctattattcttcagcaaaatgagacaaaggttcaaccagatttaaaattactgggggttaaaccaggccaagtcaacgcgcgaaacgtcatcaatgtttctttacaaaacccacaagcggcctatttaaaccaattacatttaatcaacactgtttcaaaaggaggcgaaacgctttaccaatccgatactgaggatatgcaagtggcgccaaactctaactttagttacccaatttctttaaaaggggaacgattaacgccaggaaaatatgtcttgaaatcaacggcctatggtgtaaaagatgaaaagggcacctatcaagtcaaaggcgccaatggtgaagaacggtacctgtacaaatgggaatttacaaaagaatttactatttctggggacgtcgctaaagaattaaatgaaaaagacgtaaccattaaaggaaccaattggtggttgtatctactgattgcattaatcattctagcgctgctcttattgattttcttcttgtatcgtaaaaagaaaaaagaggaagaacaacaatctgagcaataa

SEQ ID NO: 338 - protein, 358 aa
MNRWKVYATVIACMLFGWIGVEAHASEFNFAVTPTIPENQVDKSKTYFDLKMAPGAKQTVEIQLRNDTDEDITIENTVNSATTNLNGVVEYGQNGIKPDKTLRFNLKDYVEAPKEIILPKHSQKTLPLTITMPKDSFDGVMAGGITLKEKKKETTTSADQSKGLAINNEYSYVVAIILQQNETKVQPDLKLLGVKPGQVNARNVINVSLQNPQAAYLNQLHLINTVSKGGETLYQSDTEDMQVAPNSNFSYPISLKGERLTPGKYVLKSTAYGVKDEKGTYQVKGANGEERYLYKWEFTKEFTISGDVAKELNEKDVTIKGTNWWLYLLIALIILALLLLIFFLYRKKKKEEEQQSEQ

SEQ ID NO: 339 - DNA, 703 bp; double-stranded, linear
tctgaatttaattttgcggtcacaccaacaattcccgaaaatcaagtggataaatcaaaaacctactttgacttaaaaatggcgcctggtgccaaacaaaccgtagaaattcagttacgcaatgatacagatgaagacattaccattgaaaatacggtgaactcagcgacaacaaatttaaatggcgtagtagaatatggccaaaacgggatcaaacctgacaaaaccttacgttttaacttaaaagattatgtggaagcaccgaaagaaatcatcttgccgaagcattcccaaaagaccttacctttaaccattacgatgcctaaagattcttttgatggcgtgatggctggcggtataacactcaaagagaaaaagaaagaaacaacgacttctgcggatcaatcaaaagggttagctattaataatgaatactcctatgttgtggctattattcttcagcaaaatgagacaaaggttcaaccagatttaaaattactgggggttaaaccaggccaagtcaacgcgcgaaacgtcatcaatgtttctttacaaaacccacaagcggcctatttaaaccaattacatttaatcaacactgtttcaaaaggaggcgaaacgctttaccaatccgatactgaggatatgcaagtggcgccaaactctaactttagttacccaatttctttaaaaggggaacgat

SEQ ID NO: 340 - protein, 234 aa
SEFNFAVTPTIPENQVDKSKTYFDLKMAPGAKQTVEIQLRNDTDEDITIENTVNSATTNLNGVVEYGQNGIKPDKTLRFNLKDYVEAPKEIILPKHSQKTLPLTITMPKDSFDGVMAGGITLKEKKKETTTSADQSKGLAINNEYSYVVAIILQQNETKVQPDLKLLGVKPGQVNARNVINVSLQNPQAAYLNQLHLINTVSKGGETLYQSDTEDMQVAPNSNFSYPISLKGER

SEQ ID NO: 341 - DNA, 1494 bp; double-stranded, linear
tagtctctaagaaataaacctaaaattattgatataaaggatgaacaaatgaaaaaagaagaaatgcaaatgcgtaatacacgtcgtcaaaaatcaggaaaaaataataaaaagaaagtaattattacttctttggttggactagctctggttgctgggggcagttatgtttattttcaaagtcactttttnccaaccacaaaagtaaatggagtttctgtaggctggttaaatgtaaatgctgcagaagaaaaattagcgcaagttaatcaaaccgaagaagttgtggttcaaacggggacaaaagaagaaaaaattcaacttcctaaaaaataccaattggatcaaaaatttttaaaagaccatttacacagtagcaaggtgaagctaccgttaaacgaggcattcaaaaaagaactagaagccaaattagcaactttgagttttccagaggggaaaccaagcaaaaatgcgagtatccgtcgaggcaatggcacttttgaaattgttcccgaagaacaaggcacagtagtggacacacagcgcttaaaccagcagattattgcggatgttgaagcgggaaaaggcaactatcaatataatgccaaagatttttataaagcccctgaaattacaaaagaggatcaaacgttaaaggcaacattgacaacgctcaataacaagttaaataaaacaattacagttgatattaatggtgaaaaagtagcctttgataaaacacaaattcaaaacgtgctgaatgatgatggcacaatcaacaaagaaaaactaactacttgggtgacacaattagaaacaacatatggttctgctaatcaaccagttttatttacagatgttcacggcacgacacgtcgttttaaaaacaacggaagttatggctggtcgattgatggggccaaaacgcaagaactactagtaaacgcgctgaatagccaagaacaaacgaatgcaatcactgctccgttggttggtgataccaaagaaaatagtaaaattgccaataattacattgaaattgatttaaaagatcaaaaaatgtattgtttcattgatggcaaaaaaatagtcaccacagatgtcattactggcagatataacaaaggaaccgcaacagtaccaggattccatacaattttatatcggacaaccgatgtgaatttagaaggtcaaatgcttgatggttctcgatacagtgtgccagtaaaatattggatgccgttattaagtcaagggggcgttgtcacacaaatcgggattcatgactccgaccataaattggataagtatggcgataaagaagcctttaaaaccgatgctggtagtaatggctgtatcaatacgccaggaacagaagtttcaaaaatctttgatgtatcctatgacggaatgccggtaattatttatggacatatctatgatgatgcaccaggtgaatttgataaacctgtagattacggcgaagaagtataa

SEQ ID NO: 342 - protein, 474 aa
MRNTRRQKSGKNNKKKVIITSLVGLALVAGGSYVYFQSHFXPTTKVNGVSVGWLNVNAAEEKLAQVNQTEEVVVQTGTKEEKIQLPKKYQLDQKFLKDHLHSSKVKLPLNEAFKKELEAKLATLSFPEGKPSKNASIRRGNGTFEIVPEEQGTVVDTQRLNQQIIADVEAGKGNYQYNAKDFYKAPEITKEDQTLKATLTTLNNKLNKTITVDINGEKVAFDKTQIQNVLNDDGTINKEKLTTWVTQLETTYGSANQPVLFTDVHGTTRRFKNNGSYGWSIDGAKTQELLVNALNSQEQTNAITAPLVGDTKENSKIANNYIEIDLKDQKMYCFIDGKKIVTTDVITGRYNKGTATVPGFHTILYRTTDVNLEGQMLDGSRYSVPVKYWMPLLSQGGVVTQIGIHDSDHKLDKYGDKEAFKTDAGSNGCINTPGTEVSKIFDVSYDGMPVIIYGHIYDDAPGEFDKPVDYGEEV

SEQ ID NO: 343 - DNA, 1295 bp; double-stranded, linear
cacaaaagtaaatggagtttctgtaggctggttaaatgtaaatgctgcagaagaaaaattagcgcaagttaatcaaaccgaagaagttgtggttcaaacggggacaaaagaagaaaaaattcaacttcctaaaaaataccaattggatcaaaaatttttaaaagaccatttacacagtagcaaggtgaagctaccgttaaacgaggcattcaaaaaagaactagaagccaaattagcaactttgagttttccagaggggaaaccaagcaaaaatgcgagtatccgtcgaggcaatggcacttttgaaattgttcccgaagaacaaggcacagtagtggacacacagcgcttaaaccagcagattattgcggatgttgaagcgggaaaaggcaactatcaatataatgccaaagatttttataaagcccctgaaattacaaaagaggatcaaacgttaaaggcaacattgacaacgctcaataacaagttaaataaaacaattacagttgatattaatggtgaaaaagtagcctttgataaaacacaaattcaaaacgtgctgaatgatgatggcacaatcaacaaagaaaaactaactacttgggtgacacaattagaaacaacatatggttctgctaatcaaccagttttatttacagatgttcacggcacgacacgtcgttttaaaaacaacggaagttatggctggtcgattgatggggccaaaacgcaagaactactagtaaacgcgctgaatagccaagaacaaacgaatgcaatcactgctccgttggttggtgataccaaagaaaatagtaaaattgccaataattacattgaaattgatttaaaagatcaaaaaatgtattgtttcattgatggcaaaaaaatagtcaccacagatgtcattactggcagatataacaaaggaaccgcaacagtaccaggattccatacaattttatatcggacaaccgatgtgaatttagaaggtcaaatgcttgatggttctcgatacagtgtgccagtaaaatattggatgccgttattaagtcaagggggcgttgtcacacaaatcgggattcatgactccgaccataaattggataagtatggcgataaagaagcctttaaaaccgatgctggtagtaatggctgtatcaatacgccaggaacagaagtttcaaaaatctttgatgtatcctatgacggaatgccggtaattatttatggacatatctatgatgatgcaccaggtgaatttgataaacctgtagattacggcgaagaagtat

SEQ ID NO: 344 - protein, 431 aa
TKVNGVSVGWLNVNAAEEKLAQVNQTEEVVVQTGTKEEKIQLPKKYQLDQKFLKDHLHSSKVKLPLNEAFKKELEAKLATLSFPEGKPSKNASIRRGNGTFEIVPEEQGTVVDTQRLNQQIIADVEAGKGNYQYNAKDFYKAPEITKEDQTLKATLTTLNNKLNKTITVDINGEKVAFDKTQIQNVLNDDGTINKEKLTTWVTQLETTYGSANQPVLFTDVHGTTRRFKNNGSYGWSIDGAKTQELLVNALNSQEQTNAITAPLVGDTKENSKIANNYIEIDLKDQKMYCFIDGKKIVTTDVITGRYNKGTATVPGFHTILYRTTDVNLEGQMLDGSRYSVPVKYWMPLLSQGGVVTQIGIHDSDHKLDKYGDKEAFKTDAGSNGCINTPGTEVSKIFDVSYDGMPVIIYGHIYDDAPGEFDKPVDYGEEV

SEQ ID NO: 345 - DNA, 606 bp; double-stranded, linear
taattggnggagatttttatggctaaaaaaggcggatttttcttaggngcagtaattggtggaacagcagcagccgttgccgcattattacttgcaccaaaatcaggtaaagaattacgtgatgatttatcaaatcaaacagatgatttaaaaaacaaagcgcaagattacacagattatgctgttcaaaaaggaacagaattaacagaaatcgcaaaacaaaaagccggcgttttatcagatcaagcctctgatttggcaggttctgtcaaagaaaaaacaaaagattcattggataaagcacaaggtgtttctggcgacatgcttgataactttaaaaaacaaacaggtgatttatctgatcaatttaaaaaagcagctgacgatgctcaagatcacgcagaagatttaggtgaaattgccgaagatgcagcagaagatatctatattgacgttaaagattctgcggcagcggccaaagaaactgtttctgctggtgtcgatgaagcaanagaaaccaccaaagatgttcctgaaaaagctgcagaagcaaaagaagatgttaaagatgcagcgaaagacgtaaaaaaagaatttaaagggtaa

SEQ ID NO: 346 - protein, 195 aa
MAKKGGFFLGAVIGGTAAAVAALLLAPKSGKELRDDLSNQTDDLKNKAQDYTDYAVQKGTELTEIAKQKAGVLSDQASDLAGSVKEKTKDSLDKAQGVSGDMLDNFKKQTGDLSDQFKKAADDAQDHAEDLGEIAEDAAEDIYIDVKDSAAAAKETVSAGVDEAXETTKDVPEKAAEAKEDVKDAAKDVKKEFKG

SEQ ID NO: 347 - DNA, 478 bp; double-stranded, linear
atcaaatcaaacagatgatttaaaaaacaaagcgcaagattacacagattatgctgttcaaaaaggaacagaattaacagaaatcgcaaaacaaaaagccggcgttttatcagatcaagcctctgatttggcaggttctgtcaaagaaaaaacaaaagattcattggataaagcacaaggtgtttctggcgacatgcttgataactttaaaaaacaaacaggtgatttatctgatcaatttaaaaaagcagctgacgatgctcaagatcacgcagaagatttaggtgaaattgccgaagatgcagcagaagatatctatattgacgttaaagattctgcggcagcggccaaagaaactgtttctgctggtgtcgatgaagcaanagaaaccaccaaagatgttcctgaaaaagctgcagaagcaaaagaagatgttaaagatgcagcgaaagacgtaaaaaaagaatttaaagggtaa

SEQ ID NO: 348 - protein, 158 aa
SNQTDDLKNKAQDYTDYAVQKGTELTEIAKQKAGVLSDQASDLAGSVKEKTKDSLDKAQGVSGDMLDNFKKQTGDLSDQFKKAADDAQDHAEDLGEIAEDAAEDIYIDVKDSAAAAKETVSAGVDEAXETTKDVPEKAAEAKEDVKDAAKDVKKEFKG

SEQ ID NO: 349 - DNA, 336 bp; double-stranded, linear
taaggggatgaagaaaaaatggcaaaaaaaacaattatgttagtttgttccgcaggaatgagcacgagtttattagtaacaaaaatgcaaaaagcagcagaagatcgtggcatggaagcagacatctttgcagtatcggcttctgaagcagatacaaacttggaaaataaagaggtgaatgttttacttttaggtccacaagttcgtttcatgaaagggcaatttgaacaaaaattacaaccaaaagggattcctttagatgtaattaacatggcagattatggcatgatgaatggcgaaaaagttttagatcaagcaatctcattaatgggataa

SEQ ID NO: 350 - protein, 105 aa
MAKKTIMLVCSAGMSTSLLVTKMQKAAEDRGMEADIFAVSASEADTNLENKEVNVLLLGPQVRFMKGQFEQKLQPKGIPLDVINMADYGMMNGEKVLDQAISLMG

SEQ ID NO: 351 - DNA, 236 bp; double-stranded, linear
agaagatcgtggcatggaagcagacatctttgcagtatcggcttctgaagcagatacaaacttggaaaataaagaggtgaatgttttacttttaggtccacaagttcgtttcatgaaagggcaatttgaacaaaaattacaaccaaaagggattcctttagatgtaattaacatggcagattatggcatgatgaatggcgaaaaagttttagatcaagcaatctcattaatgggat

SEQ ID NO: 352 - protein, 78 aa
EDRGMEADIFAVSASEADTNLENKEVNVLLLGPQVRFMKGQFEQKLQPKGIPLDVINMADYGMMNGEKVLDQAISLMG

SEQ ID NO: 353 - DNA, 384 bp; double-stranded, linear
tagtttttttccgataaagggagaattttaatgaggcaaaaatattcaggaaacttattgttcacggccatggccattgtttatttgatgagttttctcgcccttcagttactagaagaacgtcagttaacacaaaaatttacgcaagctacccaggaatactatgcagggaaaagtatctttcatttatttcttgcagatgttaaacaaaatagacgaaagttaaaaacagaagaaaggctcgtatacgcgcaagtgaccctcgattatacatacaaaaatgaacaattaagaataactgttttattaaacaaatctggtcgaaaataccaatatcaagagagagtttctcatcaaaaaaaagcggaaacaatactggaatag

SEQ ID NO: 354 - protein, 117 aa
MRQKYSGNLLFTAMAIVYLMSFLALQLLEERQLTQKFTQATQEYYAGKSIFHLFLADVKQNRRKLKTEERLVYAQVTLDYTYKNEQLRITVLLNKSGRKYQYQERVSHQKKAETILE

SEQ ID NO: 355 - DNA, 278 bp; double-stranded, linear
ccttcagttactagaagaacgtcagttaacacaaaaatttacgcaagctacccaggaatactatgcagggaaaagtatctttcatttatttcttgcagatgttaaacaaaatagacgaaagttaaaaacagaagaaaggctcgtatacgcgcaagtgaccctcgattatacatacaaaaatgaacaattaagaataactgttttattaaacaaatctggtcgaaaataccaatatcaagagagagtttctcatcaaaaaaaagcggaaacaatactgg

SEQ ID NO: 356 - protein, 91 aa
LQLLEERQLTQKFTQATQEYYAGKSIFHLFLADVKQNRRKLKTEERLVYAQVTLDYTYKNEQLRITVLLNKSGRKYQYQERVSHQKKAETI

SEQ ID NO: 357 - DNA, 3294 bp; double-stranded, linear
taaacatttgagacattcagaggtgaatgtctcttttttattactcaaaaacgaaaggggattaattatatgaaaaaaacaacatttaaaaattggtcgttatttgcgactttggctctattaagtcaaacaattggcggaacgattggtcctacgattgcttttgccgatgaaattactcaccctcaagaggtaacaattcattatgacgtaagtaaactgtatgaagttgacggaacttttagcgatggcagcacgctctcagaacgtactacgtcattatatgcagaatacaatggtgcaaaacaaacagtattttgtattgaaccaggtgttagtattccaacagaagtgacgcacggttatcagaaaaaccctttgccatcaatgtctgataaagcgaaactagtatcggttctttgggaaaaggctggaacagatattgatacaaatatggttgcacaaaagatgatttgggaagaagtgaacggttataaactccattccataaaaagattaggtggtgcttcagttgatataaaatctattgaaggaaaaattaataaggcaattgaggagtatcaaaaaaaaccaagttttcataataccactgtaaaaacaattttaggtcaatcgacaactttaatagataaaaatgaattaaatttatctgagtttgataaagtcgtccaaaatacggcgaatatagattaccgtgtaattgggaatcaattagtgcttactccaaactctaattccaaatcaggaacattaacattgaaaaaatcagctggtactggaactccagtcgcttataaaaaagcaggacttcaaactgtgatggctggtgcgcttgataagcccaatacctacgctattaaaattaatgtggaaactaagggttctttaaagatcaaaaaaatcgataaagaatcaggtgatattgtaccagaaacggttttccatttagattttgggaaagctttaccttcaaaagatgtgacaacagataaagatgggatttctattttggatggaattccccatggtacaaaggtaactattactgaaaaatcggtgccagatccttatatgattgataccacacccatggctgccaccattaaagcgggcgagaccatttccatgacttcgaaaaatatgcgacaaaaaggtcaaattcttttagagaagactggggtagaaacaggtactgatctttggaatgacaattattctctagctggaaatacatttgccattcgtaaagacagcccagctggtgaaattgtccaagaaataacaacggatgaaaaaggtcgtgcggaaacaccaaaagagcttgctaatgctttggaactgggaacctattacgtgacagaaactaaatctagtaatggtttcgtgaataccttcaaaccaacaaaagtcgagttaaaatatgccaatcaaaccgtggctcttgttaccagtaacgtaaaagggcaaaaccaagaaattactggggaaaccactttgacaaaagaagacaaagataccggtaatgagagtcaagggaaagctgagtttaaaggagctgaatatactctctttactgcaaaagatggtcaagctgttaaatggagtgaagcttttaaaacagaattagtgaagggaacgaaagcttctgatgaaacagtgactttggctttagatgaaaagaaccaagttgccgttaaacacctagcaattaacgagtatttctggcaagaaaccaaagcacctgaaggatatactttggatgaaacgaagtatcctgtatccatcaaaaaagttgataataacgaaaaaaatgccgtaattactcgagatgttacggcaaaagaacaagttattcgctttggctttgatttctttaaatttgctggatcggctgatggcactgccgaaactggatttaacgacttatcttttaaagtgtcgccattggaagggaccaangaaatcacaggtgctgaagataaagcgaccacagcttgtaacgagcaattaggttttgatggctatggtaagtttgaaaatcttccttatggggattatttacttgaagaaatagaggctccagaaggatttcaaaagattacaccactagaaatccgttctacatttaaggaaaacaaagacgactatgcgaagagtgagtatgtctttaccattaccgaagaaggacaaaaacaaccaattaagatggtgaccgttccttacgagaaactaactaacaacgagttttctgttagtctgaaccgtttgatgctttatgatttgcccgagaaagaagatagtttgacttctcttgcgacttggaaagacggaaataaaaaattgaatacccttgattttaccgagctagttgataaattgagatataacttgcatgaaatcaaagaagactggtatgtcgtagctcaagccattgatgtggaagccacaaaagctgcccaagaaaaagacgaaaaagccaaaccggtggtgattgccgaaacaaccgcaacgttggcgaacaaagagaaaactggaacttggaaaattctgcataaattaaccgctgaacaagttttggataaaagcatcgtcttgttcaattatgtgtatgaaaacaaggtagcctttgaagcaggcaatgagccagtagcgaaggatgctagcttgaacaatcaagcacaaaccgtcaattgtacgattgaacgccatgtttccatccaaacaaaagcccacctagaagatggttcgcaaacttttactcatggtgacgtgatggatatgtttgatgatgtgtcggttacccatgatgtactggatggctcaaaagaagctttcgaaacaattctgtatgctttactaccagatggtacgaacaaagaaatttggaaatctggcaaaattgagcatgaagtgaatgataaagaatttaccaaaaccgtacttgcggaaaaagtagataccggaaagtatccagaaggaactaagtttacttttacggaaatcaattacgaaaaagatggaaacgtgaatggaaaacacaatgaagatttgaaagaaaaatctcaaaccttaacaccaaaagaagtgccaaccataccgagtacgccaaaacaaccggaaacaccagctgttccaagtaattctcaagaatctagtcccacagtgaagacattcccgcaaactggggagaaaaattccaacgttctactgttagttggctttatcttgattttttcgactgctgggtattatttctggaatcgccgcaattaa

SEQ ID NO: 358 - protein, 1074 aa
MKKTTFKNWSLFATLALLSQTIGGTIGPTIAFADEITHPQEVTIHYDVSKLYEVDGTFSDGSTLSERTTSLYAEYNGAKQTVFCIEPGVSIPTEVTHGYQKNPLPSMSDKAKLVSVLWEKAGTDIDTNMVAQKMIWEEVNGYKLHSIKRLGGASVDIKSIEGKINKAIEEYQKKPSFHNTTVKTILGQSTTLIDKNELNLSEFDKVVQNTANIDYRVIGNQLVLTPNSNSKSGTLTLKKSAGTGTPVAYKKAGLQTVMAGALDKPNTYAIKINVETKGSLKIKKIDKESGDIVPETVFHLDFGKALPSKDVTTDKDGISILDGIPHGTKVTITEKSVPDPYMIDTTPMAATIKAGETISMTSKNMRQKGQILLEKTGVETGTDLWNDNYSLAGNTFAIRKDSPAGEIVQEITTDEKGRAETPKELANALELGTYYVTETKSSNGFVNTFKPTKVELKYANQTVALVTSNVKGQNQEITGETTLTKEDKDTGNESQGKAEFKGAEYTLFTAKDGQAVKWSEAFKTELVKGTKASDETVTLALDEKNQVAVKHLAINEYFWQETKAPEGYTLDETKYPVSIKKVDNNEKNAVITRDVTAKEQVIRFGFDFFKFAGSADGTAETGFNDLSFKVSPLEGTXEITGAEDKATTACNEQLGFDGYGKFENLPYGDYLLEEIEAPEGFQKITPLEIRSTFKENKDDYAKSEYVFTITEEGQKQPIKMVTVPYEKLTNNEFSVSLNRLMLYDLPEKEDSLTSLATWKDGNKKLNTLDFTELVDKLRYNLHEIKEDWYVVAQAIDVEATKAAQEKDEKAKPVVIAETTATLANKEKTGTWKILHKLTAEQVLDKSIVLFNYVYENKVAFEAGNEPVAKDASLNNQAQTVNCTIERHVSIQTKAHLEDGSQTFTHGDVMDMFDDVSVTHDVLDGSKEAFETILYALLPDGTNKEIWKSGKIEHEVNDKEFTKTVLAEKVDTGKYPEGTKFTFTEINYEKDGNVNGKHNEDLKEKSQTLTPKEVPTIPSTPKQPETPAVPSNSQESSPTVKTFPQTGEKNSNVLLLVGFILIFSTAGYYFWNRRN

SEQ ID NO: 359 - DNA, 1511 bp; double-stranded, linear
cgatgaaattactcaccctcaagaggtaacaattcattatgacgtaagtaaactgtatgaagttgacggaacttttagcgatggcagcacgctctcagaacgtactacgtcattatatgcagaatacaatggtgcaaaacaaacagtattttgtattgaaccaggtgttagtattccaacagaagtgacgcacggttatcagaaaaaccctttgccatcaatgtctgataaagcgaaactagtatcggttctttgggaaaaggctggaacagatattgatacaaatatggttgcacaaaagatgatttgggaagaagtgaacggttataaactccattccataaaaagattaggtggtgcttcagttgatataaaatctattgaaggaaaaattaataaggcaattgaggagtatcaaaaaaaaccaagttttcataataccactgtaaaaacaattttaggtcaatcgacaactttaatagataaaaatgaattaaatttatctgagtttgataaagtcgtccaaaatacggcgaatatagattaccgtgtaattgggaatcaattagtgcttactccaaactctaattccaaatcaggaacattaacattgaaaaaatcagctggtactggaactccagtcgcttataaaaaagcaggacttcaaactgtgatggctggtgcgcttgataagcccaatacctacgctattaaaattaatgtggaaactaagggttctttaaagatcaaaaaaatcgataaagaatcaggtgatattgtaccagaaacggttttccatttagattttgggaaagctttaccttcaaaagatgtgacaacagataaagatgggatttctattttggatggaattccccatggtacaaaggtaactattactgaaaaatcggtgccagatccttatatgattgataccacacccatggctgccaccattaaagcgggcgagaccatttccatgacttcgaaaaatatgcgacaaaaaggtcaaattcttttagagaagactggggtagaaacaggtactgatctttggaatgacaattattctctagctggaaatacatttgccattcgtaaagacagcccagctggtgaaattgtccaagaaataacaacggatgaaaaaggtcgtgcggaaacaccaaaagagcttgctaatgctttggaactgggaacctattacgtgacagaaactaaatctagtaatggtttcgtgaataccttcaaaccaacaaaagtcgagttaaaatatgccaatcaaaccgtggctcttgttaccagtaacgtaaaagggcaaaaccaagaaattactggggaaaccactttgacaaaagaagacaaagataccggtaatgagagtcaagggaaagctgagtttaaaggagctgaatatactctctttactgcaaaagatggtcaagctgttaaatggagtgaagcttttaaaacagaattagtgaagggaacgaaagcttctgatgaaacag

SEQ ID NO: 360 - protein, 503 aa
DEITHPQEVTIHYDVSKLYEVDGTFSDGSTLSERTTSLYAEYNGAKQTVFCIEPGVSIPTEVTHGYQKNPLPSMSDKAKLVSVLWEKAGTDIDTNMVAQKMIWEEVNGYKLHSIKRLGGASVDIKSIEGKINKAIEEYQKKPSFHNTTVKTILGQSTTLIDKNELNLSEFDKVVQNTANIDYRVIGNQLVLTPNSNSKSGTLTLKKSAGTGTPVAYKKAGLQTVMAGALDKPNTYAIKINVETKGSLKIKKIDKESGDIVPETVFHLDFGKALPSKDVTTDKDGISILDGIPHGTKVTITEKSVPDPYMIDTTPMAATIKAGETISMTSKNMRQKGQILLEKTGVETGTDLWNDNYSLAGNTFAIRKDSPAGEIVQEITTDEKGRAETPKELANALELGTYYVTETKSSNGFVNTFKPTKVELKYANQTVALVTSNVKGQNQEITGETTLTKEDKDTGNESQGKAEFKGAEYTLFTAKDGQAVKWSEAFKTELVKGTKASDET

SEQ ID NO: 361 - DNA, 2334 bp; double-stranded, linear
taagaattgttggattgttctttagaaagaagggacaatatgaagcgaagtaaatggaaagaattgatagtaacgggcatctgccatatattagtattccccatactaatacagacaactgtttttgcagaaacattaccaagtacaaaacaagtaagagaaggaaccaatcattcattaacagcagaaaaagccgaaagtgaacaaccacagacaaaggataaactacatgatgaagaaacactggcattgtcaaaaagtgagttaatcgataatgaggctaatgttacaagtcaaacgattagagaaagaattgagacgcctaacctaacttatcgttatggatttattaatgaagaggggcagccagtaaacgccaatgagatccttctacagtatcatagttggcaaggcaattccccagatggcataaatgtgtgggaaggtgaaagtcaaccagtgacagcatctacagtggctaatttaaaagaagtggtaattccaagtgagaaagtagccgtctattccgacatgtcaacggtgcttgcagcgagtaatcaaacattttttttaccaagatattatacttctttaagcttatacaataagaaaggggaaattgatcccaattatccgctgccaactatttccgacgcatcaggaaaccaatatccaacaacaatttcgcaatttgaattggaaaaaatgtctgcacaacaatatagtcagaaaacaggagtaacgtttaacattagcgagagtcaaaaactaatcgttcctttgtacaaccaagtgaaggttgattcatcgaatcaatctgggctattgaattactttaaattttcagggccggtttattatcatgttaccaatcgcaaagtgacagaacattttgtggatactcaagggaaaccaatccctccaccaccggggtttagacaaggaaagcaaacacttattgagcgtgacccttacacctttaaacagaaagatcttttgccaagtagctatgaaattgactcaaaaacgtatcaatttcaaggatggtataaagggaaaacgaaacctgaaaatttagaaaaaagcgtaacgcccagttatgatattacctatgacgacaatgatgatttaactgttgtctataaggagatacctcaaaaaaattatacatttgaggatgtcaatggtgttgaaattgcaccaccatctgattttattcaggatcaccaacaaccaataactacggatggctttcgctatttagctggaaaaaaactgccacaacaatacagcgttaacggtaaaacttatttatatcaaggttggtatcaagataaaacnaaacaagagagcttagaaaaaacgaagcgacccataaactcccctgtttttaatgaaatgaacgctattacagcagtgtataaggaaataactgcaaaagctgaaatgcaaatagaaggactagtcaaagtcatgccaagtggttatatacaaatttggcagattatgcttacaaatgtgggagaagtaccgttaaaaaaaataaacttaaagccagcaagtggttggtcaccaggtctagctcggccaatccaagtcacgattcgtgttggatctgaaccaaacaaaattgttcctattactgatgaaaattggcgagttggcattactttaaatacggaagtgcctattggtcagacagcaactattatgatgacaacaattgctacaggtgaaccagatcaagtgttacaagcggctgttgaaatgaatggaaatttttctgctgttcacgcagctgatactgtcagaatccaacctaaaaatcaagaaattgtggcaccagatgaggaaggttttatcagcacaccaacttttgattttggcaaagtcgccatttctagcaacacgcagcaacatggtttaaagcaggcagcagattattatgaaaatggtcaggaaaatccatatttacgtttgaaaaaatcacaacccaattgggcactaactgcagaactatccccctttgaaggaagagtggatcaactatcatcaatgacaaagttattgttaggaacaaccaatgtttcaggttttattcagtacaatcaaccaacggaaactaaagttgctcttggcaaaacaaccgctattcaattagttgccaacggtgtagctagccatattgttgccaatggtcagtttgacgaaagtgatgtttatcaatttgatttttcttttgatcaaatcaaattagaaattccagcaaatcaaggtagaaaagatcaaacttatcaagcaatggtgacttggaatttagtgacaggcccataa

SEQ ID NO: 362 - protein, 764 aa
MKRSKWKELIVTGICHILVFPILIQTTVFAETLPSTKQVREGTNHSLTAEKAESEQPQTKDKLHDEETLALSKSELIDNEANVTSQTIRERIETPNLTYRYGFINEEGQPVNANEILLQYHSWQGNSPDGINVWEGESQPVTASTVANLKEVVIPSEKVAVYSDMSTVLAASNQTFFLPRYYTSLSLYNKKGEIDPNYPLPTISDASGNQYPTTISQFELEKMSAQQYSQKTGVTFNISESQKLIVPLYNQVKVDSSNQSGLLNYFKFSGPVYYHVTNRKVTEHFVDTQGKPIPPPPGFRQGKQTLIERDPYTFKQKDLLPSSYEIDSKTYQFQGWYKGKTKPENLEKSVTPSYDITYDDNDDLTVVYKEIPQKNYTFEDVNGVEIAPPSDFIQDHQQPITTDGFRYLAGKKLPQQYSVNGKTYLYQGWYQDKTKQESLEKTKRPINSPVFNEMNAITAVYKEITAKAEMQIEGLVKVMPSGYIQIWQIMLTNVGEVPLKKINLKPASGWSPGLARPIQVTIRVGSEPNKIVPITDENWRVGITLNTEVPIGQTATIMMTTIATGEPDQVLQAAVEMNGNFSAVHAADTVRIQPKNQEIVAPDEEGFISTPTFDFGKVAISSNTQQHGLKQAADYYENGQENPYLRLKKSQPNWALTAELSPFEGRVDQLSSMTKLLLGTTNVSGFIQYNQPTETKVALGKTTAIQLVANGVASHIVANGQFDESDVYQFDFSFDQIKLEIPANQGRKDQTYQAMVTWNLVTGP

SEQ ID NO: 363 - DNA, 2191 bp; double-stranded, linear
aagtacaaaacaagtaagagaaggaaccaatcattcattaacagcagaaaaagccgaaagtgaacaaccacagacaaaggataaactacatgatgaagaaacactggcattgtcaaaaagtgagttaatcgataatgaggctaatgttacaagtcaaacgattagagaaagaattgagacgcctaacctaacttatcgttatggatttattaatgaagaggggcagccagtaaacgccaatgagatccttctacagtatcatagttggcaaggcaattccccagatggcataaatgtgtgggaaggtgaaagtcaaccagtgacagcatctacagtggctaatttaaaagaagtggtaattccaagtgagaaagtagccgtctattccgacatgtcaacggtgcttgcagcgagtaatcaaacattttttttaccaagatattatacttctttaagcttatacaataagaaaggggaaattgatcccaattatccgctgccaactatttccgacgcatcaggaaaccaatatccaacaacaatttcgcaatttgaattggaaaaaatgtctgcacaacaatatagtcagaaaacaggagtaacgtttaacattagcgagagtcaaaaactaatcgttcctttgtacaaccaagtgaaggttgattcatcgaatcaatctgggctattgaattactttaaattttcagggccggtttattatcatgttaccaatcgcaaagtgacagaacattttgtggatactcaagggaaaccaatccctccaccaccggggtttagacaaggaaagcaaacacttattgagcgtgacccttacacctttaaacagaaagatcttttgccaagtagctatgaaattgactcaaaaacgtatcaatttcaaggatggtataaagggaaaacgaaacctgaaaatttagaaaaaagcgtaacgcccagttatgatattacctatgacgacaatgatgatttaactgttgtctataaggagatacctcaaaaaaattatacatttgaggatgtcaatggtgttgaaattgcaccaccatctgattttattcaggatcaccaacaaccaataactacggatggctttcgctatttagctggaaaaaaactgccacaacaatacagcgttaacggtaaaacttatttatatcaaggttggtatcaagataaaacnaaacaagagagcttagaaaaaacgaagcgacccataaactcccctgtttttaatgaaatgaacgctattacagcagtgtataaggaaataactgcaaaagctgaaatgcaaatagaaggactagtcaaagtcatgccaagtggttatatacaaatttggcagattatgcttacaaatgtgggagaagtaccgttaaaaaaaataaacttaaagccagcaagtggttggtcaccaggtctagctcggccaatccaagtcacgattcgtgttggatctgaaccaaacaaaattgttcctattactgatgaaaattggcgagttggcattactttaaatacggaagtgcctattggtcagacagcaactattatgatgacaacaattgctacaggtgaaccagatcaagtgttacaagcggctgttgaaatgaatggaaatttttctgctgttcacgcagctgatactgtcagaatccaacctaaaaatcaagaaattgtggcaccagatgaggaaggttttatcagcacaccaacttttgattttggcaaagtcgccatttctagcaacacgcagcaacatggtttaaagcaggcagcagattattatgaaaatggtcaggaaaatccatatttacgtttgaaaaaatcacaacccaattgggcactaactgcagaactatccccctttgaaggaagagtggatcaactatcatcaatgacaaagttattgttaggaacaaccaatgtttcaggttttattcagtacaatcaaccaacggaaactaaagttgctcttggcaaaacaaccgctattcaattagttgccaacggtgtagctagccatattgttgccaatggtcagtttgacgaaagtgatgtttatcaatttgatttttcttttgatcaaatcaaattagaaattccagcaaatcaaggtagaaaagatcaaacttatcaagcaatggtgacttggaatttagtgacaggccca

SEQ ID NO: 364 - protein, 730 aa
STKQVREGTNHSLTAEKAESEQPQTKDKLHDEETLALSKSELIDNEANVTSQTIRERIETPNLTYRYGFINEEGQPVNANEILLQYHSWQGNSPDGINVWEGESQPVTASTVANLKEVVIPSEKVAVYSDMSTVLAASNQTFFLPRYYTSLSLYNKKGEIDPNYPLPTISDASGNQYPTTISQFELEKMSAQQYSQKTGVTFNISESQKLIVPLYNQVKVDSSNQSGLLNYFKFSGPVYYHVTNRKVTEHFVDTQGKPIPPPPGFRQGKQTLIERDPYTFKQKDLLPSSYEIDSKTYQFQGWYKGKTKPENLEKSVTPSYDITYDDNDDLTVVYKEIPQKNYTFEDVNGVEIAPPSDFIQDHQQPITTDGFRYLAGKKLPQQYSVNGKTYLYQGWYQDKTKQESLEKTKRPINSPVFNEMNAITAVYKEITAKAEMQIEGLVKVMPSGYIQIWQIMLTNVGEVPLKKINLKPASGWSPGLARPIQVTIRVGSEPNKIVPITDENWRVGITLNTEVPIGQTATIMMTTIATGEPDQVLQAAVEMNGNFSAVHAADTVRIQPKNQEIVAPDEEGFISTPTFDFGKVAISSNTQQHGLKQAADYYENGQENPYLRLKKSQPNWALTAELSPFEGRVDQLSSMTKLLLGTTNVSGFIQYNQPTETKVALGKTTAIQLVANGVASHIVANGQFDESDVYQFDFSFDQIKLEIPANQGRKDQTYQAMVTWNLVTGP

SEQ ID NO: 365 - DNA, 1092 bp; double-stranded, linear
tgaggtggccaagttaaaatgaaaaaattacagtcactttttattggaattatcgctattattgtcatcttgttttttggcgtgcgccaattggagaaagcaagtggcatggcaggagcagataccttgaccatttacaattggggggactatatagatccggccttgattaagaaatttgaaaaagaaacaggctataaagtcaattacgaaacctttgattctaatgaagctatgtatacaaaaattcagcaaggtggcacagcctatgatattgccattccttctgaatatatgattcaaaaaatgatgaaagcgaagatgcttttaccacttgatcacagcaaattaaaaggcttagaaaacattgatgcacgctttttagatcaatcctttgatcccaaaaataagttttccgttccgtacttctggggcacgttggggattatttataatgataaatttattgacggccgtcagatccaacattgggatgatttatggcgcccggaattaaaaaataatgtcatgctgattgatggcgctcgcgaagtgttaggattatctttgaacagtttaggctattcgttaaacagtaaaaacgaccaacaattacgtcaggctaccgataagttaaaccgattaacgaacaatgtcaaagcaattgttgccgatgaaatcaaaatgtacatggctaatgaagaaagtgcagttgctgtaactttctctggtgaagctgctgaaatgctagaaaacaatgaacatctacattatgtgattcccagtgaaggctctaatctctggtttgataacattgtgatgcctaagacagccaaaaataaagagggtgcctatgcatttatgaactttatgttacgaccagaaaatgcggcacaaaatgcagaatatattggttattccacaccaaataaagaagctaaaaaactattaccaaaagaagttgccgaagataaacaattttatccagatgatgaaactatcaaacatttagaagtttaccaagacttaggtcaagaatacttaggaatttataacgatctgttcttggagtttaagatgtatcggaaataa

SEQ ID NO: 366 - protein, 357 aa
MKKLQSLFIGIIAIIVILFFGVRQLEKASGMAGADTLTIYNWGDYIDPALIKKFEKETGYKVNYETFDSNEAMYTKIQQGGTAYDIAIPSEYMIQKMMKAKMLLPLDHSKLKGLENIDARFLDQSFDPKNKFSVPYFWGTLGIIYNDKFIDGRQIQHWDDLWRPELKNNVMLIDGAREVLGLSLNSLGYSLNSKNDQQLRQATDKLNRLTNNVKAIVADEIKMYMANEESAVAVTFSGEAAEMLENNEHLHYVIPSEGSNLWFDNIVMPKTAKNKEGAYAFMNFMLRPENAAQNAEYIGYSTPNKEAKKLLPKEVAEDKQFYPDDETIKHLEVYQDLGQEYLGIYNDLFLEFKMYRK

SEQ ID NO: 367 - DNA, 988 bp; double-stranded, linear
aagtggcatggcaggagcagataccttgaccatttacaattggggggactatatagatccggccttgattaagaaatttgaaaaagaaacaggctataaagtcaattacgaaacctttgattctaatgaagctatgtatacaaaaattcagcaaggtggcacagcctatgatattgccattccttctgaatatatgattcaaaaaatgatgaaagcgaagatgcttttaccacttgatcacagcaaattaaaaggcttagaaaacattgatgcacgctttttagatcaatcctttgatcccaaaaataagttttccgttccgtacttctggggcacgttggggattatttataatgataaatttattgacggccgtcagatccaacattgggatgatttatggcgcccggaattaaaaaataatgtcatgctgattgatggcgctcgcgaagtgttaggattatctttgaacagtttaggctattcgttaaacagtaaaaacgaccaacaattacgtcaggctaccgataagttaaaccgattaacgaacaatgtcaaagcaattgttgccgatgaaatcaaaatgtacatggctaatgaagaaagtgcagttgctgtaactttctctggtgaagctgctgaaatgctagaaaacaatgaacatctacattatgtgattcccagtgaaggctctaatctctggtttgataacattgtgatgcctaagacagccaaaaataaagagggtgcctatgcatttatgaactttatgttacgaccagaaaatgcggcacaaaatgcagaatatattggttattccacaccaaataaagaagctaaaaaactattaccaaaagaagttgccgaagataaacaattttatccagatgatgaaactatcaaacatttagaagtttaccaagacttaggtcaagaatacttaggaatttataacgatctgttcttggagtttaagatgtatcggaaa

SEQ ID NO: 368 - protein, 329 aa
SGMAGADTLTIYNWGDYIDPALIKKFEKETGYKVNYETFDSNEAMYTKIQQGGTAYDIAIPSEYMIQKMMKAKMLLPLDHSKLKGLENIDARFLDQSFDPKNKFSVPYFWGTLGIIYNDKFIDGRQIQHWDDLWRPELKNNVMLIDGAREVLGLSLNSLGYSLNSKNDQQLRQATDKLNRLTNNVKAIVADEIKMYMANEESAVAVTFSGEAAEMLENNEHLHYVIPSEGSNLWFDNIVMPKTAKNKEGAYAFMNFMLRPENAAQNAEYIGYSTPNKEAKKLLPKEVAEDKQFYPDDETIKHLEVYQDLGQEYLGIYNDLFLEFKMYRK

SEQ ID NO: 369 - DNA, 1788 bp; double-stranded, linear
tagaagtattctaattatctacatagagagcgagggacaaggaatatgaaggaaaaagaaatgcattcgctcttttttaaacataagtttgtgaaagtaactccctatttacgtcgttttggtcatcgtttgagtgggatgattatgccaaatttgagtatttttattgcgtggagcttattgtctttggtggctggctatacgactgggaatctacggctagctctttctgaagtcgaaacgataatgattcgagttgttttaccgattctaattggttttacaggcggaaaaatgttcgaggaacaacgtggcggcgttgttgctgctattgcgacagtgggcgtgattgtttccacagatgttccacagttgtttggtgctatgtttattggccctttagcaggatatactttcgccaaaattgaacaaattctcttaccgaaagttaaagaaggctacgagatgctgactaaaaactttttagcaggaattgtgggaggactgctgtgctgttttggtattctggttgtagctccggctgttgaaagcgctagtttttggctgtatcaattttcttcttggttaattgaagccaatcttttaccattggttcacgttttcttagagcccttaaaagtgttattttttaataatgcgattaaccatggcttattaacgcctctaggtttagaaggtgctagtcaaacaggtcagtccattttatttctattggaaacaaaccctggaccaggcgtgggcgttttggttgcttttctgctgtttgggcctgtaggacaacgaaaaacagcaggaggtgccaccatgattcaactgattgggggcattcatgaaatttattttccgtttgttttgatggacccgcgcttatttttagcagtaattgctggaggaatgagtggtacgcttgtttttcaaatatttaatgtgggtctaagtgctccagcttcgccaggttcattggttgcgattttagccaatgccccgactgatgcgaggctggcggtttttagcggaatttttgttagctttctgtgctcttttgcaatagcaagcttgttattaaaacgtcaacgaggaattgaaccagtttcaatgataaagatgaaggaggaagaccaagtggaaacagtcacacctaactatcagcaaattttatttgtttgtgatgcaggaatgggctcaagtgccatgggggctagtttgctaagccgacaattaaaagctgtgaacttggagatgcctgtgacttaccagtccgttcatcagatgaagtggcagcctaagacattagtggtcattcaagcagaattgaaacagttagcacaaaagtacgtcccagaaaaggatatggtgagtgttcaaaattttttagaaattaaatcctattacccgcaagttttagccaaactgactgcttcttctcaagagcaatcttcacttggttcagagtctactgaaacgaactcgacaaaacaaatacagaagcttgtttttttatatgccgagaatgttcgaggatcgcaaacaatgggaatggaattattgcggcaacaagcggcgaaacaaggagtcgcgattgaagtatctaaagagccactggaaacagtcttttttaccaaggagacaacctacgtagtgactcgtgaactggcgcaagcctatcatttagatctaacgcaacaaaatttatacgtagttactagttttttgaataagaaagagtatcaagaatggctggaaggaggagctgatagatgtttttaa

SEQ ID NO: 370 - protein, 440 aa
MLTKNFLAGIVGGLLCCFGILVVAPAVESASFWLYQFSSWLIEANLLPLVHVFLEPLKVLFFNNAINHGLLTPLGLEGASQTGQSILFLLETNPGPGVGVLVAFLLFGPVGQRKTAGGATMIQLIGGIHEIYFPFVLMDPRLFLAVIAGGMSGTLVFQIFNVGLSAPASPGSLVAILANAPTDARLAVFSGIFVSFLCSFAIASLLLKRQRGIEPVSMIKMKEEDQVETVTPNYQQILFVCDAGMGSSAMGASLLSRQLKAVNLEMPVTYQSVHQMKWQPKTLVVIQAELKQLAQKYVPEKDMVSVQNFLEIKSYYPQVLAKLTASSQEQSSLGSESTETNSTKQIQKLVFLYAENVRGSQTMGMELLRQQAAKQGVAIEVSKEPLETVFFTKETTYVVTRELAQAYHLDLTQQNLYVVTSFLNKKEYQEWLEGGADRCF

SEQ ID NO: 371 - DNA, 692 bp; double-stranded, linear
acgaggaattgaaccagtttcaatgataaagatgaaggaggaagaccaagtggaaacagtcacacctaactatcagcaaattttatttgtttgtgatgcaggaatgggctcaagtgccatgggggctagtttgctaagccgacaattaaaagctgtgaacttggagatgcctgtgacttaccagtccgttcatcagatgaagtggcagcctaagacattagtggtcattcaagcagaattgaaacagttagcacaaaagtacgtcccagaaaaggatatggtgagtgttcaaaattttttagaaattaaatcctattacccgcaagttttagccaaactgactgcttcttctcaagagcaatcttcacttggttcagagtctactgaaacgaactcgacaaaacaaatacagaagcttgtttttttatatgccgagaatgttcgaggatcgcaaacaatgggaatggaattattgcggcaacaagcggcgaaacaaggagtcgcgattgaagtatctaaagagccactggaaacagtcttttttaccaaggagacaacctacgtagtgactcgtgaactggcgcaagcctatcatttagatctaacgcaacaaaatttatacgtagttactagttttttgaataagaaagagtatcaagaatggctggaaggaggagctgatagatgttttt

SEQ ID NO: 372 - protein, 230 aa
RGIEPVSMIKMKEEDQVETVTPNYQQILFVCDAGMGSSAMGASLLSRQLKAVNLEMPVTYQSVHQMKWQPKTLVVIQAELKQLAQKYVPEKDMVSVQNFLEIKSYYPQVLAKLTASSQEQSSLGSESTETNSTKQIQKLVFLYAENVRGSQTMGMELLRQQAAKQGVAIEVSKEPLETVFFTKETTYVVTRELAQAYHLDLTQQNLYVVTSFLNKKEYQEWLEGGADRCF

SEQ ID NO: 373 - DNA, 762 bp; double-stranded, linear
taaatgaaaaagacaaaagtaatgacattgatggcaaccacaactttaggcgcactggcacttgtaccaatgagtgcattagcagtcgacggtggtgaataccaaacaaacggagcgattcaatttgcaccaaatacgaacccaacgaatccagttgatccgacgaatccagacccagataaaccaattacaccagttgatccaactgatccgacagggcctaagccagggacagcaggtccgttatccattgactatgcatctagcttatcttttggggaacaaacgattacctcaaaaaatatgacctactatgcagaaacacaaaaatacaaagataacgctggtgccgaccaagaaggcccaaactttgttcaagtctcagataatcgtgggactgagacaggttggacgctaaaagtaaaacaaaatggtcaattcaaaactgaagccaaccaagaactaacagcggccaaagtaactttaagcaacggacgcgtggtttcagcttcacaatctgcaaagccaacgacagcgccagctacgattgaattaaacccaactggggctgaatcagtggtcatggctgctggcgataaagaaggtgcgggtacgtacttaatgagctggggcgatagtgtagataccgctaaaacaagtatttcattagaagtacctggttcaaccacaaaatatgcgaaaaaatacacgacaacttttacttggactttgacagatacacctgctaacacaggaaactaa

SEQ ID NO: 374 - protein, 252 aa
MKKTKVMTLMATTTLGALALVPMSALAVDGGEYQTNGAIQFAPNTNPTNPVDPTNPDPDKPITPVDPTDPTGPKPGTAGPLSIDYASSLSFGEQTITSKNMTYYAETQKYKDNAGADQEGPNFVQVSDNRGTETGWTLKVKQNGQFKTEANQELTAAKVTLSNGRVVSASQSAKPTTAPATIELNPTGAESVVMAAGDKEGAGTYLMSWGDSVDTAKTSISLEVPGSTTKYAKKYTTTFTWTLTDTPANTGN

SEQ ID NO: 375 - DNA, 677 bp; double-stranded, linear
agtcgacggtggtgaataccaaacaaacggagcgattcaatttgcaccaaatacgaacccaacgaatccagttgatccgacgaatccagacccagataaaccaattacaccagttgatccaactgatccgacagggcctaagccagggacagcaggtccgttatccattgactatgcatctagcttatcttttggggaacaaacgattacctcaaaaaatatgacctactatgcagaaacacaaaaatacaaagataacgctggtgccgaccaagaaggcccaaactttgttcaagtctcagataatcgtgggactgagacaggttggacgctaaaagtaaaacaaaatggtcaattcaaaactgaagccaaccaagaactaacagcggccaaagtaactttaagcaacggacgcgtggtttcagcttcacaatctgcaaagccaacgacagcgccagctacgattgaattaaacccaactggggctgaatcagtggtcatggctgctggcgataaagaaggtgcgggtacgtacttaatgagctggggcgatagtgtagataccgctaaaacaagtatttcattagaagtacctggttcaaccacaaaatatgcgaaaaaatacacgacaacttttacttggactttgacagatacacctgctaacacaggaaact

SEQ ID NO: 376 - protein, 225 aa
VDGGEYQTNGAIQFAPNTNPTNPVDPTNPDPDKPITPVDPTDPTGPKPGTAGPLSIDYASSLSFGEQTITSKNMTYYAETQKYKDNAGADQEGPNFVQVSDNRGTETGWTLKVKQNGQFKTEANQELTAAKVTLSNGRVVSASQSAKPTTAPATIELNPTGAESVVMAAGDKEGAGTYLMSWGDSVDTAKTSISLEVPGSTTKYAKKYTTTFTWTLTDTPANTGN

SEQ ID NO: 377 - DNA, 1089 bp; double-stranded, linear
tgatgttgtagagggctgatgaaatgtttatcagtcttctttttattgaaaggagagatcatgaagaaattaggcaaggttttaattgttagttgttttatttttattcttccttttttattatttttaggtgtattttcttctagtgaaagcggagattcttcccagtttcagcccgctacaccacaggaaaaagtagcattagaagtttctaactacgtgacgtcacatggcggaacgttgcagtttgcttccgcttggattggcaatatggaacatgaaagtggattaaatcctgctagaattcaaagtgatttatcgtttaattcagcgatagcttttaatccttcgttaggcggttatggaattgggttaggacaatgggattcaggacgaagagttaatttattaaattttgcaaaaagtcaaaaaaaggaatggaaatcagtagctttacaaatggattttgcgtggaataaggatggttctgatagtgacttacttaaaagaatgtctaaatcaaaagatgtgaatacacttgcggtagatattttgaagctgtgggaacgagctggaacaaaagatgatcccgcagaacaagtaaaaagaaaggctagtgctaataattggtataaacgactttctacaggttccatgggcggaggttcagccaatgttggtggaggaaaaattgatgccttggaaaaagtgatggggcaaactattaatggtggtcaatgttatggcttatctgctttttttgttgaaaaacaaggaggtctacaaatgatgggtacggggcatatgtttgcgagtgaaattggtaatgattatccttggagttcaattggttggacagtcataaagaatccaaattattcagatattaaagcaggagatgtcattaattttggtcaaggtggtgtggctactagtatttatgggcatactggtgtagtggcaagtgttgaaggtaaaaacaagtttactacttatgagcaaaacgctgaacaaggtcaaattgttgctaagtattttcggacttggggattagattttccacatgtgaccagcatagtaaggaaatag

SEQ ID NO: 378 - protein, 356 aa
MKCLSVFFLLKGEIMKKLGKVLIVSCFIFILPFLLFLGVFSSSESGDSSQFQPATPQEKVALEVSNYVTSHGGTLQFASAWIGNMEHESGLNPARIQSDLSFNSAIAFNPSLGGYGIGLGQWDSGRRVNLLNFAKSQKKEWKSVALQMDFAWNKDGSDSDLLKRMSKSKDVNTLAVDILKLWERAGTKDDPAEQVKRKASANNWYKRLSTGSMGGGSANVGGGKIDALEKVMGQTINGGQCYGLSAFFVEKQGGLQMMGTGHMFASEIGNDYPWSSIGWTVIKNPNYSDIKAGDVINFGQGGVATSIYGHTGVVASVEGKNKFTTYEQNAEQGQIVAKYFRTWGLDFPHVTSIVRK

SEQ ID NO: 379 - DNA, 944 bp; double-stranded, linear
tagtgaaagcggagattcttcccagtttcagcccgctacaccacaggaaaaagtagcattagaagtttctaactacgtgacgtcacatggcggaacgttgcagtttgcttccgcttggattggcaatatggaacatgaaagtggattaaatcctgctagaattcaaagtgatttatcgtttaattcagcgatagcttttaatccttcgttaggcggttatggaattgggttaggacaatgggattcaggacgaagagttaatttattaaattttgcaaaaagtcaaaaaaaggaatggaaatcagtagctttacaaatggattttgcgtggaataaggatggttctgatagtgacttacttaaaagaatgtctaaatcaaaagatgtgaatacacttgcggtagatattttgaagctgtgggaacgagctggaacaaaagatgatcccgcagaacaagtaaaaagaaaggctagtgctaataattggtataaacgactttctacaggttccatgggcggaggttcagccaatgttggtggaggaaaaattgatgccttggaaaaagtgatggggcaaactattaatggtggtcaatgttatggcttatctgctttttttgttgaaaaacaaggaggtctacaaatgatgggtacggggcatatgtttgcgagtgaaattggtaatgattatccttggagttcaattggttggacagtcataaagaatccaaattattcagatattaaagcaggagatgtcattaattttggtcaaggtggtgtggctactagtatttatgggcatactggtgtagtggcaagtgttgaaggtaaaaacaagtttactacttatgagcaaaacgctgaacaaggtcaaattgttgctaagtattttcggacttggggattagattttccacatgtgaccagcatagtaaggaaat

SEQ ID NO: 380 - protein, 314 aa
SESGDSSQFQPATPQEKVALEVSNYVTSHGGTLQFASAWIGNMEHESGLNPARIQSDLSFNSAIAFNPSLGGYGIGLGQWDSGRRVNLLNFAKSQKKEWKSVALQMDFAWNKDGSDSDLLKRMSKSKDVNTLAVDILKLWERAGTKDDPAEQVKRKASANNWYKRLSTGSMGGGSANVGGGKIDALEKVMGQTINGGQCYGLSAFFVEKQGGLQMMGTGHMFASEIGNDYPWSSIGWTVIKNPNYSDIKAGDVINFGQGGVATSIYGHTGVVASVEGKNKFTTYEQNAEQGQIVAKYFRTWGLDFPHVTSIVRK

SEQ ID NO: 381 - DNA, 306 bp; double-stranded, linear
tanttatggcaatatggaaggagttttataatgaaaaagaaacaaaaatacgcagggtttacattattagaaatgttgattgtcttattgattatttccgtattgattttactttttgtccctaacttagcgaaacataaagaaacagttgataaaaaaggcaatgaagcaatcgtaaaaattgtagaatcacaaatcgagctctacacactagaaaaaaataagacgccttccttaaatgaattagtcaacgaaggctacattactaaagagcagttagataaatatacagcagaaaagcaatga

SEQ ID NO: 382 - protein, 91 aa
MKKKQKYAGFTLLEMLIVLLIISVLILLFVPNLAKHKETVDKKGNEAIVKIVESQIELYTLEKNKTPSLNELVNEGYITKEQLDKYTAEKQ

SEQ ID NO: 383 - DNA, 167 bp; double-stranded, linear
taaagaaacagttgataaaaaaggcaatgaagcaatcgtaaaaattgtagaatcacaaatcgagctctacacactagaaaaaaataagacgccttccttaaatgaattagtcaacgaaggctacattactaaagagcagttagataaatatacagcagaaaagcaat

SEQ ID NO: 384 - protein, 55 aa
KETVDKKGNEAIVKIVESQIELYTLEKNKTPSLNELVNEGYITKEQLDKYTAEKQ

SEQ ID NO: 385 - DNA, 306 bp; double-stranded, linear; identical to SEQ ID NO: 381

SEQ ID NO: 386 - protein, 91 aa; identical to SEQ ID NO: 382

SEQ ID NO: 387 - DNA, 167 bp; double-stranded, linear; identical to SEQ ID NO: 383

SEQ ID NO: 388 - protein, 55 aa; identical to SEQ ID NO: 384

SEQ ID NO: 389 - DNA, 1200 bp; double-stranded, linear
tgaggagatgaaacgaagaaaatgaagaagaaaacgataattatattgggggcagttgcggtaattgcggttgggggcatcgtaactgtgaatgcgttaaataaaaatgcacaacaagtagctgtcaagcaagcgcctaaagatgactggggaattgactattttgacgttcccgacttgcaacaaatttatattaacggtgtcatccaaccggaacaaatggaagcctttgcgcgtgatcaaaaaataacaaaggatccagagattaaggtgaaaaacggcgatgtcgtagatgcaggcacagaattatttacttatgaagatgaggcggtcacaaaagaaattgaggcacaacaaaatagcttagccaaattagaaacgaagcgggcgaatatctataataagtggaatcgggccattgataaatttaataaaactaaagaagaagaccgcacgatgtctggtgatgatttaaatgaacaatatcaaacagaagtcgatgcagtagatgaagagattaccttcaccaatgaaaccttagcggatttaggagcgaagcaatatatttccacaaaggctaatttcaaaggtcgtgtatcaattccagaagtaaaagatgccaattcaccgattttacggttaacttcagaagatctttatttagctggaaaagtgaatgaaaaggacttgactaaaattagtgttgggcaaaaagctaaactaacttctgtttccaacaatgtggttgtggatggctcaatttcttacatcgatgataatcctcctgaaggcaacagcgatgccgcgagtggcaatccagagggcggcacaacgatgtctagttatagcgtcaaaattgcgttggccaatttagacaaagtcaaaaatggctaccatatgcaagcaaccattgatttaggcgatttaggggcgattgagttaccgaaaaaagcgattcaaaaagagggtgaacaggcctacgttttagtgaatgattttggaaccatcattcgtcgtgatgtccaagtcgggcaagaaaatggcgacaaaatggcgattgaatctggcttagaatcagccgaccgagtggttatttcttcaaaaaaaccagtaaaagtcggtgatattgttgaatcagatgcagcgattgcttctgatgaatcagcaaccaacgaatcaatgacagatgcgtcgaaatag

SEQ ID NO: 390 - protein, 392 aa
MKKKTIIILGAVAVIAVGGIVTVNALNKNAQQVAVKQAPKDDWGIDYFDVPDLQQIYINGVIQPEQMEAFARDQKITKDPEIKVKNGDVVDAGTELFTYEDEAVTKEIEAQQNSLAKLETKRANIYNKWNRAIDKFNKTKEEDRTMSGDDLNEQYQTEVDAVDEEITFTNETLADLGAKQYISTKANFKGRVSIPEVKDANSPILRLTSEDLYLAGKVNEKDLTKISVGQKAKLTSVSNNVVVDGSISYIDDNPPEGNSDAASGNPEGGTTMSSYSVKIALANLDKVKNGYHMQATIDLGDLGAIELPKKAIQKEGEQAYVLVNDFGTIIRRDVQVGQENGDKMAIESGLESADRVVISSKKPVKVGDIVESDAAIASDESATNESMTDASK

SEQ ID NO: 391 - DNA, 1097 bp; double-stranded, linear
taaaaatgcacaacaagtagctgtcaagcaagcgcctaaagatgactggggaattgactattttgacgttcccgacttgcaacaaatttatattaacggtgtcatccaaccggaacaaatggaagcctttgcgcgtgatcaaaaaataacaaaggatccagagattaaggtgaaaaacggcgatgtcgtagatgcaggcacagaattatttacttatgaagatgaggcggtcacaaaagaaattgaggcacaacaaaatagcttagccaaattagaaacgaagcgggcgaatatctataataagtggaatcgggccattgataaatttaataaaactaaagaagaagaccgcacgatgtctggtgatgatttaaatgaacaatatcaaacagaagtcgatgcagtagatgaagagattaccttcaccaatgaaaccttagcggatttaggagcgaagcaatatatttccacaaaggctaatttcaaaggtcgtgtatcaattccagaagtaaaagatgccaattcaccgattttacggttaacttcagaagatctttatttagctggaaaagtgaatgaaaaggacttgactaaaattagtgttgggcaaaaagctaaactaacttctgtttccaacaatgtggttgtggatggctcaatttcttacatcgatgataatcctcctgaaggcaacagcgatgccgcgagtggcaatccagagggcggcacaacgatgtctagttatagcgtcaaaattgcgttggccaatttagacaaagtcaaaaatggctaccatatgcaagcaaccattgatttaggcgatttaggggcgattgagttaccgaaaaaagcgattcaaaaagagggtgaacaggcctacgttttagtgaatgattttggaaccatcattcgtcgtgatgtccaagtcgggcaagaaaatggcgacaaaatggcgattgaatctggcttagaatcagccgaccgagtggttatttcttcaaaaaaaccagtaaaagtcggtgatattgttgaatcagatgcagcgattgcttctgatgaatcagcaaccaacgaatcaatgacagatgcgtcgaaat

SEQ ID NO: 392 - protein, 365 aa
KNAQQVAVKQAPKDDWGIDYFDVPDLQQIYINGVIQPEQMEAFARDQKITKDPEIKVKNGDVVDAGTELFTYEDEAVTKEIEAQQNSLAKLETKRANIYNKWNRAIDKFNKTKEEDRTMSGDDLNEQYQTEVDAVDEEITFTNETLADLGAKQYISTKANFKGRVSIPEVKDANSPILRLTSEDLYLAGKVNEKDLTKISVGQKAKLTSVSNNVVVDGSISYIDDNPPEGNSDAASGNPEGGTTMSSYSVKIALANLDKVKNGYHMQATIDLGDLGAIELPKKAIQKEGEQAYVLVNDFGTIIRRDVQVGQENGDKMAIESGLESADRVVISSKKPVKVGDIVESDAAIASDESATNESMTDASK

SEQ ID NO: 393 - DNA, 3294 bp; double-stranded, linear; identical to SEQ ID NO: 357

SEQ ID NO: 394 - protein, 1074 aa; identical to SEQ ID NO: 358

SEQ ID NO: 395 - DNA, 1502 bp; double-stranded, linear
tttagatgaaaagaaccaagttgccgttaaacacctagcaattaacgagtatttctggcaagaaaccaaagcacctgaaggatatactttggatgaaacgaagtatcctgtatccatcaaaaaagttgataataacgaaaaaaatgccgtaattactcgagatgttacggcaaaagaacaagttattcgctttggctttgatttctttaaatttgctggatcggctgatggcactgccgaaactggatttaacgacttatcttttaaagtgtcgccattggaagggaccaangaaatcacaggtgctgaagataaagcgaccacagcttgtaacgagcaattaggttttgatggctatggtaagtttgaaaatcttccttatggggattatttacttgaagaaatagaggctccagaaggatttcaaaagattacaccactagaaatccgttctacatttaaggaaaacaaagacgactatgcgaagagtgagtatgtctttaccattaccgaagaaggacaaaaacaaccaattaagatggtgaccgttccttacgagaaactaactaacaacgagttttctgttagtctgaaccgtttgatgctttatgatttgcccgagaaagaagatagtttgacttctcttgcgacttggaaagacggaaataaaaaattgaatacccttgattttaccgagctagttgataaattgagatataacttgcatgaaatcaaagaagactggtatgtcgtagctcaagccattgatgtggaagccacaaaagctgcccaagaaaaagacgaaaaagccaaaccggtggtgattgccgaaacaaccgcaacgttggcgaacaaagagaaaactggaacttggaaaattctgcataaattaaccgctgaacaagttttggataaaagcatcgtcttgttcaattatgtgtatgaaaacaaggtagcctttgaagcaggcaatgagccagtagcgaaggatgctagcttgaacaatcaagcacaaaccgtcaattgtacgattgaacgccatgtttccatccaaacaaaagcccacctagaagatggttcgcaaacttttactcatggtgacgtgatggatatgtttgatgatgtgtcggttacccatgatgtactggatggctcaaaagaagctttcgaaacaattctgtatgctttactaccagatggtacgaacaaagaaatttggaaatctggcaaaattgagcatgaagtgaatgataaagaatttaccaaaaccgtacttgcggaaaaagtagataccggaaagtatccagaaggaactaagtttacttttacggaaatcaattacgaaaaagatggaaacgtgaatggaaaacacaatgaagatttgaaagaaaaatctcaaaccttaacaccaaaagaagtgccaaccataccgagtacgccaaaacaaccggaaacaccagctgttccaagtaattctcaagaatctagtcccacagtgaaga

SEQ ID NO: 396 - protein, 500 aa
LDEKNQVAVKHLAINEYFWQETKAPEGYTLDETKYPVSIKKVDNNEKNAVITRDVTAKEQVIRFGFDFFKFAGSADGTAETGFNDLSFKVSPLEGTXEITGAEDKATTACNEQLGFDGYGKFENLPYGDYLLEEIEAPEGFQKITPLEIRSTFKENKDDYAKSEYVFTITEEGQKQPIKMVTVPYEKLTNNEFSVSLNRLMLYDLPEKEDSLTSLATWKDGNKKLNTLDFTELVDKLRYNLHEIKEDWYVVAQAIDVEATKAAQEKDEKAKPVVIAETTATLANKEKTGTWKILHKLTAEQVLDKSIVLFNYVYENKVAFEAGNEPVAKDASLNNQAQTVNCTIERHVSIQTKAHLEDGSQTFTHGDVMDMFDDVSVTHDVLDGSKEAFETILYALLPDGTNKEIWKSGKIEHEVNDKEFTKTVLAEKVDTGKYPEGTKFTFTEINYEKDGNVNGKHNEDLKEKSQTLTPKEVPTIPSTPKQPETPAVPSNSQESSPTVK

SEQ ID NO: 397 - DNA, 1002 bp; double-stranded, linear
taagataggtttatcaaagaaaaggagcgatgctttatgaaaaagaaagtattaagttcgattactttagtaacattaagtacgttacttatagcaggttatgcaagtccagcatttgcagatcatgcagccaatccaaatagtgctacagcaaatttaggcaaacatcaaaacaatggccaaacaagaggcgacaaggcgactaagattttatctggcacggactggcaaggaacccgtgtttatgatgctgctggtaatgatttaacggcagaaaatgctaattttattggtttagcaaaatatgatggtgaaaccggtttttacgagtttttcgacaaaaatactggggaaacccgtggtgacgaaggaacattttttgtgacaggtgatggcacaaaacgaattttaatttcgcggacacaaaattatcaagccgtagtggatttaaccgaagtgagtaaagacnaatttacttacaagcgtttagggaaagataaactggggaatgatgttgaagtttacgtggaacacatcccttatcatgggaaaaaattagcttttacaaatggacgtgaagcattaaccaatcaaactggcaaaattgtgacaaataaatcaggggataaaattttaggaacaaccttgtggaatggcacaaaagtcgtagataaaaacggtaatgatgtgacagcggccaatcaaaatttcattagtttagcgaaatttgatccaaacacaagtaaatatgaatttttcaatttacaaacaggtgaaacccgcggcgactttgggtacttccaagtggtggacaataacaagattcgggcccatgtatctattggtacgaatcgttacggcgcggcgctagaattaacggaactaaacaatgatcgatttacgtatactcgaatgggtaaagataatgctggtaatgatattcaagtgttcgtggaacatgaaccttaccaaggcacatatcatccagcctttactttctaa

SEQ ID NO: 398 - protein, 321 aa
MKKKVLSSITLVTLSTLLIAGYASPAFADHAANPNSATANLGKHQNNGQTRGDKATKILSGTDWQGTRVYDAAGNDLTAENANFIGLAKYDGETGFYEFFDKNTGETRGDEGTFFVTGDGTKRILISRTQNYQAVVDLTEVSKDXFTYKRLGKDKLGNDVEVYVEHIPYHGKKLAFTNGREALTNQTGKIVTNKSGDKILGTTLWNGTKVVDKNGNDVTAANQNFISLAKFDPNTSKYEFFNLQTGETRGDFGYFQVVDNNKIRAHVSIGTNRYGAALELTELNNDRFTYTRMGKDNAGNDIQVFVEHEPYQGTYHPAFTF

SEQ ID NO: 399 - DNA, 869 bp; double-stranded, linear
tcatgcagccaatccaaatagtgctacagcaaatttaggcaaacatcaaaacaatggccaaacaagaggcgacaaggcgactaagattttatctggcacggactggcaaggaacccgtgtttatgatgctgctggtaatgatttaacggcagaaaatgctaattttattggtttagcaaaatatgatggtgaaaccggtttttacgagtttttcgacaaaaatactggggaaacccgtggtgacgaaggaacattttttgtgacaggtgatggcacaaaacgaattttaatttcgcggacacaaaattatcaagccgtagtggatttaaccgaagtgagtaaagacnaatttacttacaagcgtttagggaaagataaactggggaatgatgttgaagtttacgtggaacacatcccttatcatgggaaaaaattagcttttacaaatggacgtgaagcattaaccaatcaaactggcaaaattgtgacaaataaatcaggggataaaattttaggaacaaccttgtggaatggcacaaaagtcgtagataaaaacggtaatgatgtgacagcggccaatcaaaatttcattagtttagcgaaatttgatccaaacacaagtaaatatgaatttttcaatttacaaacaggtgaaacccgcggcgactttgggtacttccaagtggtggacaataacaagattcgggcccatgtatctattggtacgaatcgttacggcgcggcgctagaattaacggaactaaacaatgatcgatttacgtatactcgaatgggtaaagataatgctggtaatgatattcaagtgttcgtggaacatgaaccttaccaaggcacatatcatccagcct

SEQ ID NO: 400 - protein, 289 aa
HAANPNSATANLGKHQNNGQTRGDKATKILSGTDWQGTRVYDAAGNDLTAENANFIGLAKYDGETGFYEFFDKNTGETRGDEGTFFVTGDGTKRILISRTQNYQAVVDLTEVSKDXFTYKRLGKDKLGNDVEVYVEHIPYHGKKLAFTNGREALTNQTGKIVTNKSGDKILGTTLWNGTKVVDKNGNDVTAANQNFISLAKFDPNTSKYEFFNLQTGETRGDFGYFQVVDNNKIRAHVSIGTNRYGAALELTELNNDRFTYTRMGKDNAGNDIQVFVEHEPYQGTYHPA

SEQ ID NO: 401 - DNA, 4359 bp; double-stranded, linear
tgaaaggggattagtatgaagaaaaaaactttttcttttgtgatgttgagtatacttctcgcacaaaatttcgggtttgccgtaaatgcctatgctgtaacaacgacagaagcacaaacagagaccactgatacagcaaaaaaagaggcagagttatcgaactcaacaccatctttacctttagcaacaacgactacttcagaaatgaatcaaccaactgcaacaactgaatcgcaaaccacagaggcgagcacaacagcttccagtgatgctgctacaccatctgaacaacaaacaacggaggacaaggacacctcacttaatgaaaaagccctgccagatgttcaagcgccaattacagatgaactacttgacagtatgagtcttgcgccgattggtggaacagaatacagccaaacagaggttcaccgcgaattaaatacaacaccggtaaccgctacgttccaatttgctgttggaaacacaggttatgcacctggatcagtttatacagttcaattaccagaacatttaggttattcaactgtcagcggagaagtgacaggcattggcgcaacttgggcagtcgatgcggcgaccaaaacattaagtattacgtttaatcaacgagtttcagatacttcctttaaagtagaactaaaaagttatctaacaacagaggcggaaccattaatcaaaattgaaactccaggaaaaaataaaaaaacctactcgtttgatttatatgaacaagtggaaccaattcaatataacgaacgaaccagaacgacggggttagatggcgaaattttttataatttagaccggacgttaactggcaatcaaacattagaattattaacaacagagacgccaggcgctgtctttggaaaacaagataacttggaacctcaagttttcagttacgatgtcgacattaatggtcaaattttaccagaaacgcaaaccttgttaacacctggcaaagattatacattaagcgataattcactcgggcggattgctgtaactgttccaaacatgaatcaacaaaaagcctattccttatcgattaatcggacaatttatttagagagtgcttcggactataactacttatattcgcagcagtatccaacaacaaaaattgggtcaatttctttgaaaagtacgacaggaactaaacaaacaaccgattttactgctaagacgagtcaaacaagtaaagtaattgctgatcgtgaaatgcgtagtatgtcctatatcagttttcaaagcaaagggaaatattatgtaacaatttatggcacgttaacagaaacaaaagtgggtcaacaaatcgtattagagagtacaaacggtcaagaaattaagaatcctaaatttacggcgtatggtcctttatatgaaaatgtaaaattggaagactattttgatattaaaactgaaggtggcaagctcactttaacggccacaaaagatagctatttaagaataaatatttctgatttaacaatggattttgacaagaaggacattaatctatcattaagtacacctgtaattggtcctaataaagccattcaattagtatccgatcaatatattgaaccaattagtgttgttaatcctttgaatgctgaaactgcttggggtaattatgatcaaaatggtgcctattcatcaagaacaactgtctcagttatgggaagcaaagagaaaccgattcaaaatttagaaattaaagtaaagcatcctaattatctttcattacgagctacaaaagaaatttatttttattacaagttaggaacggattatacagtaacgccaacgtcagatggttcagttattaagttcactacgccaataaccaacgaaatccaaattccaattggttttaattatgtgccagatagtttgccaaaagataaaagtatcccagtcgatacgataccgataacaatgagtgctgaaggtttaactccagttgatacgacagtaactactaatagtaagcgtggttctgaacgaacacttcaaagtagtaaaaatcaattccttgtcaatgcacgaaatgattcttttgactcactaagcgtccgtacaaaaattccagctggcgccgatgttctttttgacatttatgatgtttcaaacgatcaggtagattcaatttatccacaatactgggaccgcggtcaatactttgataaaccaatgacgccaaacagccctggatatccaacgattacttttgacgaaaataccaatagttacacgtttgattttggaaaaaccaacaaacgttacattattgagtataaaaacgccaatggctggatcgacgtgccaactctttatataacagggacagcgaaagaaccacaatcgaataataatgaaggctctgcttcggtttctgttcaaaatgaagcgttagacattttgagtgcaacacaagcggcgaatccaacattaaaaaatgtaacaaaaacgacagtaacaacaaaaaatattgataataaaacacatcgtgtgaaaaatccaacgattgaattaacaccaaaaggcacaaccaatgctcaaatcgatttgaattctattaccgtgaaaggcgtgccagaagatgcttattcattagagaagactacaaacggtgcgaaagtcatttttaaagactatacattgacagaaaacattacgattgaatacaatacggtctctgcaaacgctggccaaatctatacagaaacaacaatcgactctgaaacattgaaccagatgtctgctagcaagaaaaaagtcaccactgcgccaatcacattgaaattctcagaaggtgatgcggaaggtattgtttatttagcaactgccacattctacacgcataacgtagaggatgaaaaccaagcaattgcgaaggtttcttttgaactaattgataatgtcacgcatacagcaaccgaatttacaacagatgaaaaaggtcaatactcctttgatgccatcatgacaggtgattatactttgcgagtaacgaatgtaccgcaggaatattccgtggatgaagagtatttgacaggaaaagccattaagctggtcaaaggagacaaccaactaaaaattccattaacgaaaacaattgatcacagtcgtttacaagtcaaagattcaacgatttatgtcggcgattcatggaaaccagaagagaactttgtttcagcaacagataaaacaggtcaagacgttcccttcgaaaaaatcactgtttcaggtcaagttgataacancaaagcaggcgtttatccaattatttacagtgacgaaggtaaagaagaaacagcctatgtgaccgtcaaacccgaccaatctaagttagaggtcaaagatacaacgatttatgttggtgattcgtggaaaccagaagataatttcgtttcagcgacagacaaaacaggtcaagacgtnccgtttgaaaaaattgatgttcagggaacagtgaatgttgataaaataggcgattatgaaattgtctataaaaatggcanaaaagaagcgaaagcaatcgttcatgtccgtgatgacagtcagttagaggttaaagatacaacgatttatgttggtgattcgtggaaaccagaagataatttcgtttcagcaacagacaaaacaggccaagacgttccgtttgaaaaaatcactgtttcaggtcaagttgatactagcaaagcaggcgtttatccaatcgtttacagttacgaaggtaaagaagaaacagctaatgtgactgtcaaacccgaccaatctaagttagaggttaaagatacaacgatttatgtgggcgataaatgggaaccagaagataatttcgtttcagcaacagacaaaacaggtcaagatgtcccgtttgaaaaaattgacgttcagggaacagtgaatgttgataaaataggcgattatgaaattgtctataaaaatggcacaaaagaagcgaaagcaatcgttcatgtccgtgatgacagtcagttagaggtcaaagatacaacaatttatgtgggtgataaatgggaagcagaagataacttcgtttccgcgacagacaaaacaggtcaagacgttccgtttgaaaaaattgatgttcagggaacagtgaatgttgataaaataggcgattatgaaattgtctataaaaatggcacaaaagaagcgaaagcaatcgttcatgtccgtgatgatagtcgtttacaagtcaaggatacaacgatttatgtcggcgattcntgganaccagaagngaactttgtttcagcnacagataaaacaggtcaagatgtcccattcgaaaaaatcactgtt

SEQ ID NO: 402 - protein, 1448 aa
MKKKTFSFVMLSILLAQNFGFAVNAYAVTTTEAQTETTDTAKKEAELSNSTPSLPLATTTTSEMNQPTATTESQTTEASTTASSDAATPSEQQTTEDKDTSLNEKALPDVQAPITDELLDSMSLAPIGGTEYSQTEVHRELNTTPVTATFQFAVGNTGYAPGSVYTVQLPEHLGYSTVSGEVTGIGATWAVDAATKTLSITFNQRVSDTSFKVELKSYLTTEAEPLIKIETPGKNKKTYSFDLYEQVEPIQYNERTRTTGLDGEIFYNLDRTLTGNQTLELLTTETPGAVFGKQDNLEPQVFSYDVDINGQILPETQTLLTPGKDYTLSDNSLGRIAVTVPNMNQQKAYSLSINRTIYLESASDYNYLYSQQYPTTKIGSISLKSTTGTKQTTDFTAKTSQTSKVIADREMRSMSYISFQSKGKYYVTIYGTLTETKVGQQIVLESTNGQEIKNPKFTAYGPLYENVKLEDYFDIKTEGGKLTLTATKDSYLRINISDLTMDFDKKDINLSLSTPVIGPNKAIQLVSDQYIEPISVVNPLNAETAWGNYDQNGAYSSRTTVSVMGSKEKPIQNLEIKVKHPNYLSLRATKEIYFYYKLGTDYTVTPTSDGSVIKFTTPITNEIQIPIGFNYVPDSLPKDKSIPVDTIPITMSAEGLTPVDTTVTTNSKRGSERTLQSSKNQFLVNARNDSFDSLSVRTKIPAGADVLFDIYDVSNDQVDSIYPQYWDRGQYFDKPMTPNSPGYPTITFDENTNSYTFDFGKTNKRYIIEYKNANGWIDVPTLYITGTAKEPQSNNNEGSASVSVQNEALDILSATQAANPTLKNVTKTTVTTKNIDNKTHRVKNPTIELTPKGTTNAQIDLNSITVKGVPEDAYSLEKTTNGAKVIFKDYTLTENITIEYNTVSANAGQIYTETTIDSETLNQMSASKKKVTTAPITLKFSEGDAEGIVYLATATFYTHNVEDENQAIAKVSFELIDNVTHTATEFTTDEKGQYSFDAIMTGDYTLRVTNVPQEYSVDEEYLTGKAIKLVKGDNQLKIPLTKTIDHSRLQVKDSTIYVGDSWKPEENFVSATDKTGQDVPFEKITVSGQVDNXKAGVYPIIYSDEGKEETAYVTVKPDQSKLEVKDTTIYVGDSWKPEDNFVSATDKTGQDVPFEKIDVQGTVNVDKIGDYEIVYKNGXKEAKAIVHVRDDSQLEVKDTTIYVGDSWKPEDNFVSATDKTGQDVPFEKITVSGQVDTSKAGVYPIVYSYEGKEETANVTVKPDQSKLEVKDTTIYVGDKWEPEDNFVSATDKTGQDVPFEKIDVQGTVNVDKIGDYEIVYKNGTKEAKAIVHVRDDSQLEVKDTTIYVGDKWEAEDNFVSATDKTGQDVPFEKIDVQGTVNVDKIGDYEIVYKNGTKEAKAIVHVRDDSRLQVKDTTIYVGDSWXPEXNFVSATDKTGQDVPFEKITV

SEQ ID NO: 403 - DNA, 4249 bp; double-stranded, linear
tgtaacaacgacagaagcacaaacagagaccactgatacagcaaaaaaagaggcagagttatcgaactcaacaccatctttacctttagcaacaacgactacttcagaaatgaatcaaccaactgcaacaactgaatcgcaaaccacagaggcgagcacaacagcttccagtgatgctgctacaccatctgaacaacaaacaacggaggacaaggacacctcacttaatgaaaaagccctgccagatgttcaagcgccaattacagatgaactacttgacagtatgagtcttgcgccgattggtggaacagaatacagccaaacagaggttcaccgcgaattaaatacaacaccggtaaccgctacgttccaatttgctgttggaaacacaggttatgcacctggatcagtttatacagttcaattaccagaacatttaggttattcaactgtcagcggagaagtgacaggcattggcgcaacttgggcagtcgatgcggcgaccaaaacattaagtattacgtttaatcaacgagtttcagatacttcctttaaagtagaactaaaaagttatctaacaacagaggcggaaccattaatcaaaattgaaactccaggaaaaaataaaaaaacctactcgtttgatttatatgaacaagtggaaccaattcaatataacgaacgaaccagaacgacggggttagatggcgaaattttttataatttagaccggacgttaactggcaatcaaacattagaattattaacaacagagacgccaggcgctgtctttggaaaacaagataacttggaacctcaagttttcagttacgatgtcgacattaatggtcaaattttaccagaaacgcaaaccttgttaacacctggcaaagattatacattaagcgataattcactcgggcggattgctgtaactgttccaaacatgaatcaacaaaaagcctattccttatcgattaatcggacaatttatttagagagtgcttcggactataactacttatattcgcagcagtatccaacaacaaaaattgggtcaatttctttgaaaagtacgacaggaactaaacaaacaaccgattttactgctaagacgagtcaaacaagtaaagtaattgctgatcgtgaaatgcgtagtatgtcctatatcagttttcaaagcaaagggaaatattatgtaacaatttatggcacgttaacagaaacaaaagtgggtcaacaaatcgtattagagagtacaaacggtcaagaaattaagaatcctaaatttacggcgtatggtcctttatatgaaaatgtaaaattggaagactattttgatattaaaactgaaggtggcaagctcactttaacggccacaaaagatagctatttaagaataaatatttctgatttaacaatggattttgacaagaaggacattaatctatcattaagtacacctgtaattggtcctaataaagccattcaattagtatccgatcaatatattgaaccaattagtgttgttaatcctttgaatgctgaaactgcttggggtaattatgatcaaaatggtgcctattcatcaagaacaactgtctcagttatgggaagcaaagagaaaccgattcaaaatttagaaattaaagtaaagcatcctaattatctttcattacgagctacaaaagaaatttatttttattacaagttaggaacggattatacagtaacgccaacgtcagatggttcagttattaagttcactacgccaataaccaacgaaatccaaattccaattggttttaattatgtgccagatagtttgccaaaagataaaagtatcccagtcgatacgataccgataacaatgagtgctgaaggtttaactccagttgatacgacagtaactactaatagtaagcgtggttctgaacgaacacttcaaagtagtaaaaatcaattccttgtcaatgcacgaaatgattcttttgactcactaagcgtccgtacaaaaattccagctggcgccgatgttctttttgacatttatgatgtttcaaacgatcaggtagattcaatttatccacaatactgggaccgcggtcaatactttgataaaccaatgacgccaaacagccctggatatccaacgattacttttgacgaaaataccaatagttacacgtttgattttggaaaaaccaacaaacgttacattattgagtataaaaacgccaatggctggatcgacgtgccaactctttatataacagggacagcgaaagaaccacaatcgaataataatgaaggctctgcttcggtttctgttcaaaatgaagcgttagacattttgagtgcaacacaagcggcgaatccaacattaaaaaatgtaacaaaaacgacagtaacaacaaaaaatattgataataaaacacatcgtgtgaaaaatccaacgattgaattaacaccaaaaggcacaaccaatgctcaaatcgatttgaattctattaccgtgaaaggcgtgccagaagatgcttattcattagagaagactacaaacggtgcgaaagtcatttttaaagactatacattgacagaaaacattacgattgaatacaatacggtctctgcaaacgctggccaaatctatacagaaacaacaatcgactctgaaacattgaaccagatgtctgctagcaagaaaaaagtcaccactgcgccaatcacattgaaattctcagaaggtgatgcggaaggtattgtttatttagcaactgccacattctacacgcataacgtagaggatgaaaaccaagcaattgcgaaggtttcttttgaactaattgataatgtcacgcatacagcaaccgaatttacaacagatgaaaaaggtcaatactcctttgatgccatcatgacaggtgattatactttgcgagtaacgaatgtaccgcaggaatattccgtggatgaagagtatttgacaggaaaagccattaagctggtcaaaggagacaaccaactaaaaattccattaacgaaaacaattgatcacagtcgtttacaagtcaaagattcaacgatttatgtcggcgattcatggaaaccagaagagaactttgtttcagcaacagataaaacaggtcaagacgttcccttcgaaaaaatcactgtttcaggtcaagttgataacancaaagcaggcgtttatccaattatttacagtgacgaaggtaaagaagaaacagcctatgtgaccgtcaaacccgaccaatctaagttagaggtcaaagatacaacgatttatgttggtgattcgtggaaaccagaagataatttcgtttcagcgacagacaaaacaggtcaagacgtnccgtttgaaaaaattgatgttcagggaacagtgaatgttgataaaataggcgattatgaaattgtctataaaaatggcanaaaagaagcgaaagcaatcgttcatgtccgtgatgacagtcagttagaggttaaagatacaacgatttatgttggtgattcgtggaaaccagaagataatttcgtttcagcaacagacaaaacaggccaagacgttccgtttgaaaaaatcactgtttcaggtcaagttgatactagcaaagcaggcgtttatccaatcgtttacagttacgaaggtaaagaagaaacagctaatgtgactgtcaaacccgaccaatctaagttagaggttaaagatacaacgatttatgtgggcgataaatgggaaccagaagataatttcgtttcagcaacagacaaaacaggtcaagatgtcccgtttgaaaaaattgacgttcagggaacagtgaatgttgataaaataggcgattatgaaattgtctataaaaatggcacaaaagaagcgaaagcaatcgttcatgtccgtgatgacagtcagttagaggtcaaagatacaacaatttatgtgggtgataaatgggaagcagaagataacttcgtttccgcgacagacaaaacaggtcaagacgttccgtttgaaaaaattgatgttcagggaacagtgaatgttgataaaataggcgattatgaaattgtctataaaaatggcacaaaagaagcgaaagcaatcgttcatgtccgtgatgatagtcgtttacaagtcaaggatacaacgatttatgtcggcgattcntgganaccagaagngaactttgtttcagcnacagataaaacaggtcaagatgtcccattc

SEQ ID NO: 404 - protein, 1416 aa
VTTTEAQTETTDTAKKEAELSNSTPSLPLATTTTSEMNQPTATTESQTTEASTTASSDAATPSEQQTTEDKDTSLNEKALPDVQAPITDELLDSMSLAPIGGTEYSQTEVHRELNTTPVTATFQFAVGNTGYAPGSVYTVQLPEHLGYSTVSGEVTGIGATWAVDAATKTLSITFNQRVSDTSFKVELKSYLTTEAEPLIKIETPGKNKKTYSFDLYEQVEPIQYNERTRTTGLDGEIFYNLDRTLTGNQTLELLTTETPGAVFGKQDNLEPQVFSYDVDINGQILPETQTLLTPGKDYTLSDNSLGRIAVTVPNMNQQKAYSLSINRTIYLESASDYNYLYSQQYPTTKIGSISLKSTTGTKQTTDFTAKTSQTSKVIADREMRSMSYISFQSKGKYYVTIYGTLTETKVGQQIVLESTNGQEIKNPKFTAYGPLYENVKLEDYFDIKTEGGKLTLTATKDSYLRINISDLTMDFDKKDINLSLSTPVIGPNKAIQLVSDQYIEPISVVNPLNAETAWGNYDQNGAYSSRTTVSVMGSKEKPIQNLEIKVKHPNYLSLRATKEIYFYYKLGTDYTVTPTSDGSVIKFTTPITNEIQIPIGFNYVPDSLPKDKSIPVDTIPITMSAEGLTPVDTTVTTNSKRGSERTLQSSKNQFLVNARNDSFDSLSVRTKIPAGADVLFDIYDVSNDQVDSIYPQYWDRGQYFDKPMTPNSPGYPTITFDENTNSYTFDFGKTNKRYIIEYKNANGWIDVPTLYITGTAKEPQSNNNEGSASVSVQNEALDILSATQAANPTLKNVTKTTVTTKNIDNKTHRVKNPTIELTPKGTTNAQIDLNSITVKGVPEDAYSLEKTTNGAKVIFKDYTLTENITIEYNTVSANAGQIYTETTIDSETLNQMSASKKKVTTAPITLKFSEGDAEGIVYLATATFYTHNVEDENQAIAKVSFELIDNVTHTATEFTTDEKGQYSFDAIMTGDYTLRVTNVPQEYSVDEEYLTGKAIKLVKGDNQLKIPLTKTIDHSRLQVKDSTIYVGDSWKPEENFVSATDKTGQDVPFEKITVSGQVDNXKAGVYPIIYSDEGKEETAYVTVKPDQSKLEVKDTTIYVGDSWKPEDNFVSATDKTGQDVPFEKIDVQGTVNVDKIGDYEIVYKNGXKEAKAIVHVRDDSQLEVKDTTIYVGDSWKPEDNFVSATDKTGQDVPFEKITVSGQVDTSKAGVYPIVYSYEGKEETANVTVKPDQSKLEVKDTTIYVGDKWEPEDNFVSATDKTGQDVPFEKIDVQGTVNVDKIGDYEIVYKNGTKEAKAIVHVRDDSQLEVKDTTIYVGDKWEAEDNFVSATDKTGQDVPFEKIDVQGTVNVDKIGDYEIVYKNGTKEAKAIVHVRDDSRLQVKDTTIYVGDSWXPEXNFVSATDKTGQDVPF

SEQ ID NO: 405 - DNA, 804 bp; double-stranded, linear
taaatgaaaaaaacagtcgtctactccttgttattcggaacaatgttgcttggcgccactgttcctgctgaagcggcgacggtcgtttttgatagcgaacagtcgattgtttttaccccaagcacagatgggacggatccagtaaatccagaaaatcccgatccagaaaaaccagttcgaccagtcgatccaacgaatcctgatggacctaatccaggtacccctggtccactttccatcgattatgcctcaagtttggattttgggagtaatgagatatcgaataaggatcaaacgtattttgccagagcgcaaacctatagaaatccagatggttcagcaagtgaattggcaactgctaattatgtacaagtaagtgatttacggggaaccaatgctggctgggttttaaaagtgaaacaaaatggtcaatttcgtaatgcagaaacattacacaaagaattaacaggcgccaccgtcgcctttactgagcccagtgttcgctcaaatgcgacggacgtattgccgccaactgctaccgcaaacattcaattagatgctgcgggcgcagaaactgttgtcatgcaagccccagaaaagaccggcgccggaacgtggatcacgctgtgggggcaagcagaaaaagtgaccgaaaaaaatcaacaaggacagcaagtaaatgccacaatcacacgggcaatctcactaactgttcctgggaaaacccctaaggatgcagtacaatataaaacaacattgacttggctactttcagatgtaccagtaaataatggagggaaataa

SEQ ID NO: 406 - protein, 266 aa
MKKTVVYSLLFGTMLLGATVPAEAATVVFDSEQSIVFTPSTDGTDPVNPENPDPEKPVRPVDPTNPDGPNPGTPGPLSIDYASSLDFGSNEISNKDQTYFARAQTYRNPDGSASELATANYVQVSDLRGTNAGWVLKVKQNGQFRNAETLHKELTGATVAFTEPSVRSNATDVLPPTATANIQLDAAGAETVVMQAPEKTGAGTWITLWGQAEKVTEKNQQGQQVNATITRAISLTVPGKTPKDAVQYKTTLTWLLSDVPVNNGGK

SEQ ID NO: 407 - DNA, 668 bp; double-stranded, linear
ggcgacggtcgtttttgatagcgaacagtcgattgtttttaccccaagcacagatgggacggatccagtaaatccagaaaatcccgatccagaaaaaccagttcgaccagtcgatccaacgaatcctgatggacctaatccaggtacccctggtccactttccatcgattatgcctcaagtttggattttgggagtaatgagatatcgaataaggatcaaacgtattttgccagagcgcaaacctatagaaatccagatggttcagcaagtgaattggcaactgctaattatgtacaagtaagtgatttacggggaaccaatgctggctgggttttaaaagtgaaacaaaatggtcaatttcgtaatgcagaaacattacacaaagaattaacaggcgccaccgtcgcctttactgagcccagtgttcgctcaaatgcgacggacgtattgccgccaactgctaccgcaaacattcaattagatgctgcgggcgcagaaactgttgtcatgcaagccccagaaaagaccggcgccggaacgtggatcacgctgtgggggcaagcagaaaaagtgaccgaaaaaaatcaacaaggacagcaagtaaatgccacaatcacacgggcaatctcactaactgttcctgggaaaacccctaaggatgcagtac

SEQ ID NO: 408 - protein, 222 aa
ATVVFDSEQSIVFTPSTDGTDPVNPENPDPEKPVRPVDPTNPDGPNPGTPGPLSIDYASSLDFGSNEISNKDQTYFARAQTYRNPDGSASELATANYVQVSDLRGTNAGWVLKVKQNGQFRNAETLHKELTGATVAFTEPSVRSNATDVLPPTATANIQLDAAGAETVVMQAPEKTGAGTWITLWGQAEKVTEKNQQGQQVNATITRAISLTVPGKTPKDAV

SEQ ID NO: 409 - DNA, 1053 bp; double-stranded, linear
tagtcgtttatgaagaaaaaaatcgttggtacaattacgttgttggctttaagtgcgttattagttggtggagcaggaggggctttgacggcagaagcatacgttcctcaaagcgtagacaatcccaataatttaggggatttacctgagtatttacgttcagttggtattagacaagatgaaggattatcagaaaaagattgggctggaacacgcgtttatgatcgaaatgggaatgacttaacagatgaaaatcaaaacctattacatgcaatcaaatttgatgcaaccactagtttctatgaattttttgataaagagactggagaatcaacaggagatgaaggaaccttctttatgaccgctggtattacagatgtttcccgtcttgtaattatttctgaaaccaaaaattatcaaggtgtatacccacttagaactttataccaagatacttttacgtatagacagatggggaaagataaaaacggaaatgatattgaagttttcgtagaaaacaaagcaacctcaggaccagtttatggtcgtccgcagccataccccaataatcgtcccagaacactagaattcacgaatggacgccgtgccatgacagaacaaacaggccagattgatgtaaatcgacaaggggatgaaattattggtaaaacttcctttgatgggacaccgcaacttctttggaatggcacaaaagtagtggataaagatggcaatgacgtaacttcggccaaccaaaactttatcagcttagcgaaatttgaccaagatagcagcaaatatgaatttttcaatttacaaactggtgaaactcgtggcgactatggctactttaaagtaggaaatcaaaataaattccgtgcccatgtttccattggaaccaatcgctatggcgctgtcttagagttaacagaattgaatgataatcgttttacgtacacacgaatgggtaaagataacgaaggaaacgatatccaagtctatgtggaacatgaaccataccaaggaacttttaatcctgaatttaccttttaa

SEQ ID NO: 410 - protein, 347 aa
MKKKIVGTITLLALSALLVGGAGGALTAEAYVPQSVDNPNNLGDLPEYLRSVGIRQDEGLSEKDWAGTRVYDRNGNDLTDENQNLLHAIKFDATTSFYEFFDKETGESTGDEGTFFMTAGITDVSRLVIISETKNYQGVYPLRTLYQDTFTYRQMGKDKNGNDIEVFVENKATSGPVYGRPQPYPNNRPRTLEFTNGRRAMTEQTGQIDVNRQGDEIIGKTSFDGTPQLLWNGTKVVDKDGNDVTSANQNFISLAKFDQDSSKYEFFNLQTGETRGDYGYFKVGNQNKFRAHVSIGTNRYGAVLELTELNDNRFTYTRMGKDNEGNDIQVYVEHEPYQGTFNPEFTF

SEQ ID NO: 411 - DNA, 932 bp; double-stranded, linear
atacgttcctcaaagcgtagacaatcccaataatttaggggatttacctgagtatttacgttcagttggtattagacaagatgaaggattatcagaaaaagattgggctggaacacgcgtttatgatcgaaatgggaatgacttaacagatgaaaatcaaaacctattacatgcaatcaaatttgatgcaaccactagtttctatgaattttttgataaagagactggagaatcaacaggagatgaaggaaccttctttatgaccgctggtattacagatgtttcccgtcttgtaattatttctgaaaccaaaaattatcaaggtgtatacccacttagaactttataccaagatacttttacgtatagacagatggggaaagataaaaacggaaatgatattgaagttttcgtagaaaacaaagcaacctcaggaccagtttatggtcgtccgcagccataccccaataatcgtcccagaacactagaattcacgaatggacgccgtgccatgacagaacaaacaggccagattgatgtaaatcgacaaggggatgaaattattggtaaaacttcctttgatgggacaccgcaacttctttggaatggcacaaaagtagtggataaagatggcaatgacgtaacttcggccaaccaaaactttatcagcttagcgaaatttgaccaagatagcagcaaatatgaatttttcaatttacaaactggtgaaactcgtggcgactatggctactttaaagtaggaaatcaaaataaattccgtgcccatgtttccattggaaccaatcgctatggcgctgtcttagagttaacagaattgaatgataatcgttttacgtacacacgaatgggtaaagataacgaaggaaacgatatccaagtctatgtggaacatgaaccataccaaggaactt

SEQ ID NO: 412 - protein, 310 aa
YVPQSVDNPNNLGDLPEYLRSVGIRQDEGLSEKDWAGTRVYDRNGNDLTDENQNLLHAIKFDATTSFYEFFDKETGESTGDEGTFFMTAGITDVSRLVIISETKNYQGVYPLRTLYQDTFTYRQMGKDKNGNDIEVFVENKATSGPVYGRPQPYPNNRPRTLEFTNGRRAMTEQTGQIDVNRQGDEIIGKTSFDGTPQLLWNGTKVVDKDGNDVTSANQNFISLAKFDQDSSKYEFFNLQTGETRGDYGYFKVGNQNKFRAHVSIGTNRYGAVLELTELNDNRFTYTRMGKDNEGNDIQVYVEHEPYQGT

SEQ ID NO: 413 - DNA, 3078 bp; double-stranded, linear
taaaaaacggcactcaatatgtcaaaatttgaaatttcaagctgtgtgttctttggtaaaatanatanaaaaatgctagttatcagtatcgataataacaggatactgattaagaaaggactttatagagactatagattgaatttttacatagaaagaaggagcaagatgaagcgagtaaattggaaaagatggctagttgttgggttaagttgttctttgttcatggattcagtggttggtgtgactgtgttagcggaaacgattactggggcgacggagcaaggagtagcaacatctcagtcgagtgacgaagcgagccagacgacgcaaacaaccgaagagtcacaggcaacggtcgctagtgaagcgaaaacagtaccgccacaggaaacggcaagaattgcttctcgagcgattggttattcttctgtggaagggcgcgagattccctttttctttgtggaggaagacgggacgttgtttgatcccgaccgaattacgatggcggtcaatctttccacgttttcgttttatgaagagaaattacaacgaaccccccttgagcccaccactgtgaatggcggaaagttactgtctattccaacgtcaccagcttttaaatatgatacaaataaccagaatccaagtaatatttatggcgtttctgaagtgtcgtttactattcctaaggagtatcaaagcctggacattcgaccaagtacgttttatacaggagacactacgcaatatccagtgccaacggtttttgcgaacgttgggggcaaagtgacgaactatgtgggcgccaatgcggagacggaattagagttaaccaatgaaaaaatgcccaataagctgacgtttggtcctaaaaagacgtttaaatatacggtagctacggcaccaggaggcgttacgtatgcgctgacctatttttatggagatgtcggcggtccaactagttcgcaccaaagacgaggaacagcgggtcctgtgtattattatttaacaaagcggcgtgtcacggaaaaatttgagaatcccgcaggcggggcgattcctgcgccagaaggttatacgcaggataagaaaaccattgtaacaggggaggattttacttttacccaagaaggcaccttgcctgaacgttacacaggcagtgatgggaagacgtatttatttaaaggttggtacaaagggaatgcgaaacctagcacgttggaaaccaccaaaacgcctagttatgcggtgacctatgatgacaatgacgatttgcatgtggtctatgaagaagcagtgatgaaaacctatacgttgccagcgagagaagctttgttcggctatgttgatgagcaaggaaacttgattaatcccgccaagtttaagctaagtgcgaccatgggtgaaagtgacggagccacaggggaaatgacgacttttcccacaattgatggaatcgatatgccagcaagtcaattaaagaaattagccatcccgcaaaaagtctacacacgcccagacgatgggacaatcgtaacttatggcccgcaagaagtgagtgttgaaattcctaagtattaccagacgatttcgatttcaccaactactgcgtatacaggggataaaaccaagtatccagtaccaaatgaagtgcgccgtggcatcgaaaaccccgacaacattgttagtagtttagtgggaancnctgcgtataacttgacccaaaaaagtgccacacgctatactgcccgccgttcttactggangtggggccccacgaagacactttactcaatgagtatctattcaggaactgctgggggcaactataatttatcgacccctgatggcaccatttattattacttagaaaatcggcgggtcactgaacattttgtagacgaaagtggcgcaaaaatcacgccaccaactggctttacacaaggaaatcagctagtggtggacagtgaaaactatgtctacactgtcgcaaaagctttgccgaagatctaccaagctggtgaaaaaacctatatcttccaaggctggtttaaaggcaaaaccaagccagcaacattaaagacgacaacgaccccaagttttacaccaacttttaatgatgaggacgacatgaccgctgtgtaccaagaagcgattcccaccgcggaactaacgttaacaggtgccgttgacataatcgaaaatggcgccacaatggattactgggaggcgctactgaagaacacaggcgaagcgccgttaaccaccattaaaatcaagccaacggcaacttgggcggctggcatcggcgcacccaacacgatatttgtacaaggaacgggtcaaaacaccaaagcttttcctgtcaccaaagaacaatggacgaccggtgcaggagtgtccatcacgttggatcagcctttaccagctggcggtcaattaaaaatgaacttattaggaaccgccgttacaggaaatcctggtcaagttttaaccgctgatgttgaagtaacgggcaactttggcagtttaactgccaaagatacggtccgtattaaagacttagatcaagaaattacgagtcctgacggcgacggctttattagtaccccgacatttgattttggtaaactagcaatttcaggaagtaagcaacaatatggtttgaagaaggccgcagattactacggcaatggcactcgcaacccttatttacgcctgaatactagccaagccaattggagtttaacggcccagctatcgcaaccaaaatcagccacagacagcttgccaacaacgacccgcttgttgctaggaacggccgctgctgccagctttaccgattacaaccaaccaacagaaaccaggacaccacttggcaagaccagcaccgtgactttaaccgccgacaataccgcaacagcggtggtcgcaaaccaacagttcacaggcagtgacgtctatcagttggacttcacgtttgctaacatcaaactagaagtgccagccaaccaaggtatggctggccaacaataccaagccgccgtcacgtggaatttagtgactggcccctaa

SEQ ID NO: 414 - protein, 969 aa
MKRVNWKRWLVVGLSCSLFMDSVVGVTVLAETITGATEQGVATSQSSDEASQTTQTTEESQATVASEAKTVPPQETARIASRAIGYSSVEGREIPFFFVEEDGTLFDPDRITMAVNLSTFSFYEEKLQRTPLEPTTVNGGKLLSIPTSPAFKYDTNNQNPSNIYGVSEVSFTIPKEYQSLDIRPSTFYTGDTTQYPVPTVFANVGGKVTNYVGANAETELELTNEKMPNKLTFGPKKTFKYTVATAPGGVTYALTYFYGDVGGPTSSHQRRGTAGPVYYYLTKRRVTEKFENPAGGAIPAPEGYTQDKKTIVTGEDFTFTQEGTLPERYTGSDGKTYLFKGWYKGNAKPSTLETTKTPSYAVTYDDNDDLHVVYEEAVMKTYTLPAREALFGYVDEQGNLINPAKFKLSATMGESDGATGEMTTFPTIDGIDMPASQLKKLAIPQKVYTRPDDGTIVTYGPQEVSVEIPKYYQTISISPTTAYTGDKTKYPVPNEVRRGIENPDNIVSSLVGXXAYNLTQKSATRYTARRSYWXWGPTKTLYSMSIYSGTAGGNYNLSTPDGTIYYYLENRRVTEHFVDESGAKITPPTGFTQGNQLVVDSENYVYTVAKALPKIYQAGEKTYIFQGWFKGKTKPATLKTTTTPSFTPTFNDEDDMTAVYQEAIPTAELTLTGAVDIIENGATMDYWEALLKNTGEAPLTTIKIKPTATWAAGIGAPNTIFVQGTGQNTKAFPVTKEQWTTGAGVSITLDQPLPAGGQLKMNLLGTAVTGNPGQVLTADVEVTGNFGSLTAKDTVRIKDLDQEITSPDGDGFISTPTFDFGKLAISGSKQQYGLKKAADYYGNGTRNPYLRLNTSQANWSLTAQLSQPKSATDSLPTTTRLLLGTAAAASFTDYNQPTETRTPLGKTSTVTLTADNTATAVVANQQFTGSDVYQLDFTFANIKLEVPANQGMAGQQYQAAVTWNLVTGP

SEQ ID NO: 415 - DNA, 2798 bp; double-stranded, linear
ggagcaaggagtagcaacatctcagtcgagtgacgaagcgagccagacgacgcaaacaaccgaagagtcacaggcaacggtcgctagtgaagcgaaaacagtaccgccacaggaaacggcaagaattgcttctcgagcgattggttattcttctgtggaagggcgcgagattccctttttctttgtggaggaagacgggacgttgtttgatcccgaccgaattacgatggcggtcaatctttccacgttttcgttttatgaagagaaattacaacgaaccccccttgagcccaccactgtgaatggcggaaagttactgtctattccaacgtcaccagcttttaaatatgatacaaataaccagaatccaagtaatatttatggcgtttctgaagtgtcgtttactattcctaaggagtatcaaagcctggacattcgaccaagtacgttttatacaggagacactacgcaatatccagtgccaacggtttttgcgaacgttgggggcaaagtgacgaactatgtgggcgccaatgcggagacggaattagagttaaccaatgaaaaaatgcccaataagctgacgtttggtcctaaaaagacgtttaaatatacggtagctacggcaccaggaggcgttacgtatgcgctgacctatttttatggagatgtcggcggtccaactagttcgcaccaaagacgaggaacagcgggtcctgtgtattattatttaacaaagcggcgtgtcacggaaaaatttgagaatcccgcaggcggggcgattcctgcgccagaaggttatacgcaggataagaaaaccattgtaacaggggaggattttacttttacccaagaaggcaccttgcctgaacgttacacaggcagtgatgggaagacgtatttatttaaaggttggtacaaagggaatgcgaaacctagcacgttggaaaccaccaaaacgcctagttatgcggtgacctatgatgacaatgacgatttgcatgtggtctatgaagaagcagtgatgaaaacctatacgttgccagcgagagaagctttgttcggctatgttgatgagcaaggaaacttgattaatcccgccaagtttaagctaagtgcgaccatgggtgaaagtgacggagccacaggggaaatgacgacttttcccacaattgatggaatcgatatgccagcaagtcaattaaagaaattagccatcccgcaaaaagtctacacacgcccagacgatgggacaatcgtaacttatggcccgcaagaagtgagtgttgaaattcctaagtattaccagacgatttcgatttcaccaactactgcgtatacaggggataaaaccaagtatccagtaccaaatgaagtgcgccgtggcatcgaaaaccccgacaacattgttagtagtttagtgggaancnctgcgtataacttgacccaaaaaagtgccacacgctatactgcccgccgttcttactggangtggggccccacgaagacactttactcaatgagtatctattcaggaactgctgggggcaactataatttatcgacccctgatggcaccatttattattacttagaaaatcggcgggtcactgaacattttgtagacgaaagtggcgcaaaaatcacgccaccaactggctttacacaaggaaatcagctagtggtggacagtgaaaactatgtctacactgtcgcaaaagctttgccgaagatctaccaagctggtgaaaaaacctatatcttccaaggctggtttaaaggcaaaaccaagccagcaacattaaagacgacaacgaccccaagttttacaccaacttttaatgatgaggacgacatgaccgctgtgtaccaagaagcgattcccaccgcggaactaacgttaacaggtgccgttgacataatcgaaaatggcgccacaatggattactgggaggcgctactgaagaacacaggcgaagcgccgttaaccaccattaaaatcaagccaacggcaacttgggcggctggcatcggcgcacccaacacgatatttgtacaaggaacgggtcaaaacaccaaagcttttcctgtcaccaaagaacaatggacgaccggtgcaggagtgtccatcacgttggatcagcctttaccagctggcggtcaattaaaaatgaacttattaggaaccgccgttacaggaaatcctggtcaagttttaaccgctgatgttgaagtaacgggcaactttggcagtttaactgccaaagatacggtccgtattaaagacttagatcaagaaattacgagtcctgacggcgacggctttattagtaccccgacatttgattttggtaaactagcaatttcaggaagtaagcaacaatatggtttgaagaaggccgcagattactacggcaatggcactcgcaacccttatttacgcctgaatactagccaagccaattggagtttaacggcccagctatcgcaaccaaaatcagccacagacagcttgccaacaacgacccgcttgttgctaggaacggccgctgctgccagctttaccgattacaaccaaccaacagaaaccaggacaccacttggcaagaccagcaccgtgactttaaccgccgacaataccgcaacagcggtggtcgcaaaccaacagttcacaggcagtgacgtctatcagttggacttcacgtttgctaacatcaaactagaagtgccagccaaccaaggtatggctggccaacaataccaagccgccgtcacgtggaatttagtgactggcccct

SEQ ID NO: 416 - protein, 932 aa
EQGVATSQSSDEASQTTQTTEESQATVASEAKTVPPQETARIASRAIGYSSVEGREIPFFFVEEDGTLFDPDRITMAVNLSTFSFYEEKLQRTPLEPTTVNGGKLLSIPTSPAFKYDTNNQNPSNIYGVSEVSFTIPKEYQSLDIRPSTFYTGDTTQYPVPTVFANVGGKVTNYVGANAETELELTNEKMPNKLTFGPKKTFKYTVATAPGGVTYALTYFYGDVGGPTSSHQRRGTAGPVYYYLTKRRVTEKFENPAGGAIPAPEGYTQDKKTIVTGEDFTFTQEGTLPERYTGSDGKTYLFKGWYKGNAKPSTLETTKTPSYAVTYDDNDDLHVVYEEAVMKTYTLPAREALFGYVDEQGNLINPAKFKLSATMGESDGATGEMTTFPTIDGIDMPASQLKKLAIPQKVYTRPDDGTIVTYGPQEVSVEIPKYYQTISISPTTAYTGDKTKYPVPNEVRRGIENPDNIVSSLVGXXAYNLTQKSATRYTARRSYWXWGPTKTLYSMSIYSGTAGGNYNLSTPDGTIYYYLENRRVTEHFVDESGAKITPPTGFTQGNQLVVDSENYVYTVAKALPKIYQAGEKTYIFQGWFKGKTKPATLKTTTTPSFTPTFNDEDDMTAVYQEAIPTAELTLTGAVDIIENGATMDYWEALLKNTGEAPLTTIKIKPTATWAAGIGAPNTIFVQGTGQNTKAFPVTKEQWTTGAGVSITLDQPLPAGGQLKMNLLGTAVTGNPGQVLTADVEVTGNFGSLTAKDTVRIKDLDQEITSPDGDGFISTPTFDFGKLAISGSKQQYGLKKAADYYGNGTRNPYLRLNTSQANWSLTAQLSQPKSATDSLPTTTRLLLGTAAAASFTDYNQPTETRTPLGKTSTVTLTADNTATAVVANQQFTGSDVYQLDFTFANIKLEVPANQGMAGQQYQAAVTWNLVTGP

SEQ ID NO: 417 - DNA, 3840 bp; double-stranded, linear
taatcggtttggcgggaatcgtacatagaaagaagggacgacatgaagcaaactaagtggcaacgattagcaaccattggcttgtgtagttctttagtaattaacgccttttctggtgtgacggcagttgcggaaaccgtgacgattgaaagtagtccgaccgccgaaagtagtgccaaggaagagacgcaagcaagtagcgtgaaggaagaaacaacgaaagccagtacggaaaatagtcaagtaacaactgacacgagtcaggaagaagcaacgaaagaagcggagaaagaagaaccgcaagcagaagtggaacaagcagaaacaccaatcattcctaaaccaaaaaaaatcaatatgaaggcaacttattcattttctgcagaaacttatcagtttggatttgtgaatgaatcaggtcaattaataaatccagatattataccaattacgtatagctatgccaaaggatcatggaagacagatggttataatcgaaagtggactagtatggttcaagggagtgcttcaaccgtaggaaacttaaagaatgtaataatgccagcaacttctgtagttatgccaccaggaccgtcatatgaaggaactcaagaggtgtacacaaacttttcaattcgcataccaaaatattatgcatcagcgagtctctacaatagagaaggtaaaattgattctacttatccgttacctgctattgcactagcaggtactagaccgctatctttgactcaaagtagtgtaattagtgcattggcgctgaccagtaaaggagacaatgtttatacaccacgggaaacattttttggaggagatcctgcaggtgtaaagtttactaattttttgtatcgtataaatgactttgatgtgaaaggtaataacataggttataagactgtgagtagcccaatctattaccatctgaccaaccgccgtgtcaccgaaaacttcgtagatacaagtggcgccaaaatcacgccaccaagtaatttcacccaagggaaacaaacggtcattaacagtgatccttacacgttccaacaaagtggttttttacccgagacctacaaagttggcacgaaatcttaccgattcaaaggctggtacaaagggaaaaccaaaaccgagcctttggccaccactaaaacacctagctataaagtcacgtatgatgacaatgatgatttgacggtggtctatgaggagttttcagggtacgagctgcctgcttcgaccaatcaatttggctttgtggatgaagcgacgaacaaattaattgcccccgaccaagtgcagatgaagtataatcttactttaaatgaaaataataaaaaaacagtaatgagcagtaacttaacggggacagatacagcgacactgaaaaacttgtccgtgcctgtcaactattttgaacaatatcgcgtcaatacgttttatggcgcgagtgacattacgtttacattgcccaaacggtacaaatcaatcaatattaccaaatcagatggcaaaaccgacccagcttttcctcttcctaaaatctataatatagatcaagtagaaatgtcacacatgcctgtgaccacttataacaagttgaaacagctgtcgggccaaacgtttggctttaatgctttagccgatcaacctgaattttatacgaaaacgttatttgggacagagtctggcatcgatgacccagtcaattattatacaatgagtggccctgtttactattatttagaaaaccgcaaagtcaccgagaacttcgtagacaccaacggcgctaaaatcacaccgccaacaggtttcacccaaggtaaaaaaacggtgattacaagcgacgcctacactttcaaacaagcaggcaccttaccagacacttacacaacaggcggtaagacctacaagttcaaaggttggtacaaaggcaagtccatactcaacacattgacaactaccaaagcgccaagttatcaagtgacctacgatgacaatgatgatttgaatgtggtgtatgaagaagaaacagttacgacagtgtatccatcagtcgatatgaactttgtgaatgaaaaaggcggggctttcacaccggcgttaacttttagtggtaagtactatgcgcaaagtacgagtgcgtacttaagaaccgatttatatgacgtgacctcaaaaaataatggtaatgggcaatatacggtaagtattaataatggtagtatgccattgtcccaagaattattgaaaaaatataataatggacaaccaatcagtgctaccaacagattacagtttaatgttgataaattagccatcgaccaacaactaaaatatgttgacagcattcaattagacacagctcaaagtagcaatctgaaatcctatagatatgtgtacacgaacaatagctcactggttttcgacccaaatgtagcaccagcagaggttgaccttagttcagaatctcttaacttgcttaattttgattcagatggcacctatttttctaatgcaaataatagacttttttacacgcatttaggatatagtggcacaccaggagttaactatcttctcgtaatgtttctttttaacgccaaacctgcggataagtcaaaacttgtctacaaagtcactcgcaaacaagtcaccgaaaacttcgtggatgtcaacggtgccaaaatcactgcaccaacaggcttcacccaaggtaaccaagtaccaatgaacagtaacaccttcaagtacacagcggcaaaagctttaccagcgacgtatactacaggtggcaaagtctatacgttccaagggtggtataaagggaaaaccaagccaagtacgttgaacaaaacaacaactccaacgttcaatgcgacctttgatggcaatgacgatatgaccgccatgtataaggaagaaataccaacagctagtgtcacattaactcgaccaaaagaagtgattgatacgaataccaatgtaatctggacaacaacgatcacgaatactagcaaagcacccttacaaaatctcaccttgaaaaaagggcccaattggtcagctggtctgacgatcccgacctttatggaagtgacaccagaaggagaaacgacaaaatcaatcccagtaaatagtacactttggacagagggggttcctttaccaaatgccgttcctatcggcaaaaaagtttcagttgctttcacaactcgcgcaacagggaaaccaaacactgttttgaaagcagaagttgtagtatttggtggtattaaagatagtacagtggataacttcgtgagaattcgtccaaatgatcaagaagtagtcacaccaacgaccgaaggcttcatcagtgtgccaaccttcgacttcggccaagtgggcgttgcaggaactaagcaacaacacagcttgaaacaagccgcggattactacggtaacggcacacggaatccgtatctgcggattaagaaaacgcaacccaattggagcttaacagcgcaactgtcacaaccaaaatcagcgacagacagcttgcctacagcgacccgcttattattaggggcggcgcctgtctctagctttaccaattacaatcaaccaaccgagttgaaaaatacggtcggtaccacgagtgccattagcttaacagccaacaacacagcaacgagtattattgccaacaagcaattcacaggtagtaatgtttatcagttggacttcaccttcaataatgtcaaacttgaagtgccagccaatcaaggtgttaaagggcaacaatacaaggccgcagttacatggaacctagttacaggtccttaa

SEQ ID NO: 418 - protein, 1265 aa
MKQTKWQRLATIGLCSSLVINAFSGVTAVAETVTIESSPTAESSAKEETQASSVKEETTKASTENSQVTTDTSQEEATKEAEKEEPQAEVEQAETPIIPKPKKINMKATYSFSAETYQFGFVNESGQLINPDIIPITYSYAKGSWKTDGYNRKWTSMVQGSASTVGNLKNVIMPATSVVMPPGPSYEGTQEVYTNFSIRIPKYYASASLYNREGKIDSTYPLPAIALAGTRPLSLTQSSVISALALTSKGDNVYTPRETFFGGDPAGVKFTNFLYRINDFDVKGNNIGYKTVSSPIYYHLTNRRVTENFVDTSGAKITPPSNFTQGKQTVINSDPYTFQQSGFLPETYKVGTKSYRFKGWYKGKTKTEPLATTKTPSYKVTYDDNDDLTVVYEEFSGYELPASTNQFGFVDEATNKLIAPDQVQMKYNLTLNENNKKTVMSSNLTGTDTATLKNLSVPVNYFEQYRVNTFYGASDITFTLPKRYKSINITKSDGKTDPAFPLPKIYNIDQVEMSHMPVTTYNKLKQLSGQTFGFNALADQPEFYTKTLFGTESGIDDPVNYYTMSGPVYYYLENRKVTENFVDTNGAKITPPTGFTQGKKTVITSDAYTFKQAGTLPDTYTTGGKTYKFKGWYKGKSILNTLTTTKAPSYQVTYDDNDDLNVVYEEETVTTVYPSVDMNFVNEKGGAFTPALTFSGKYYAQSTSAYLRTDLYDVTSKNNGNGQYTVSINNGSMPLSQELLKKYNNGQPISATNRLQFNVDKLAIDQQLKYVDSIQLDTAQSSNLKSYRYVYTNNSSLVFDPNVAPAEVDLSSESLNLLNFDSDGTYFSNANNRLFYTHLGYSGTPGVNYLLVMFLFNAKPADKSKLVYKVTRKQVTENFVDVNGAKITAPTGFTQGNQVPMNSNTFKYTAAKALPATYTTGGKVYTFQGWYKGKTKPSTLNKTTTPTFNATFDGNDDMTAMYKEEIPTASVTLTRPKEVIDTNTNVIWTTTITNTSKAPLQNLTLKKGPNWSAGLTIPTFMEVTPEGETTKSIPVNSTLWTEGVPLPNAVPIGKKVSVAFTTRATGKPNTVLKAEVVVFGGIKDSTVDNFVRIRPNDQEVVTPTTEGFISVPTFDFGQVGVAGTKQQHSLKQAADYYGNGTRNPYLRIKKTQPNWSLTAQLSQPKSATDSLPTATRLLLGAAPVSSFTNYNQPTELKNTVGTTSAISLTANNTATSIIANKQFTGSNVYQLDFTFNNVKLEVPANQGVKGQQYKAAVTWNLVTGP

SEQ ID NO: 419 - DNA, 3695 bp; double-stranded, linear
cgtgacgattgaaagtagtccgaccgccgaaagtagtgccaaggaagagacgcaagcaagtagcgtgaaggaagaaacaacgaaagccagtacggaaaatagtcaagtaacaactgacacgagtcaggaagaagcaacgaaagaagcggagaaagaagaaccgcaagcagaagtggaacaagcagaaacaccaatcattcctaaaccaaaaaaaatcaatatgaaggcaacttattcattttctgcagaaacttatcagtttggatttgtgaatgaatcaggtcaattaataaatccagatattataccaattacgtatagctatgccaaaggatcatggaagacagatggttataatcgaaagtggactagtatggttcaagggagtgcttcaaccgtaggaaacttaaagaatgtaataatgccagcaacttctgtagttatgccaccaggaccgtcatatgaaggaactcaagaggtgtacacaaacttttcaattcgcataccaaaatattatgcatcagcgagtctctacaatagagaaggtaaaattgattctacttatccgttacctgctattgcactagcaggtactagaccgctatctttgactcaaagtagtgtaattagtgcattggcgctgaccagtaaaggagacaatgtttatacaccacgggaaacattttttggaggagatcctgcaggtgtaaagtttactaattttttgtatcgtataaatgactttgatgtgaaaggtaataacataggttataagactgtgagtagcccaatctattaccatctgaccaaccgccgtgtcaccgaaaacttcgtagatacaagtggcgccaaaatcacgccaccaagtaatttcacccaagggaaacaaacggtcattaacagtgatccttacacgttccaacaaagtggttttttacccgagacctacaaagttggcacgaaatcttaccgattcaaaggctggtacaaagggaaaaccaaaaccgagcctttggccaccactaaaacacctagctataaagtcacgtatgatgacaatgatgatttgacggtggtctatgaggagttttcagggtacgagctgcctgcttcgaccaatcaatttggctttgtggatgaagcgacgaacaaattaattgcccccgaccaagtgcagatgaagtataatcttactttaaatgaaaataataaaaaaacagtaatgagcagtaacttaacggggacagatacagcgacactgaaaaacttgtccgtgcctgtcaactattttgaacaatatcgcgtcaatacgttttatggcgcgagtgacattacgtttacattgcccaaacggtacaaatcaatcaatattaccaaatcagatggcaaaaccgacccagcttttcctcttcctaaaatctataatatagatcaagtagaaatgtcacacatgcctgtgaccacttataacaagttgaaacagctgtcgggccaaacgtttggctttaatgctttagccgatcaacctgaattttatacgaaaacgttatttgggacagagtctggcatcgatgacccagtcaattattatacaatgagtggccctgtttactattatttagaaaaccgcaaagtcaccgagaacttcgtagacaccaacggcgctaaaatcacaccgccaacaggtttcacccaaggtaaaaaaacggtgattacaagcgacgcctacactttcaaacaagcaggcaccttaccagacacttacacaacaggcggtaagacctacaagttcaaaggttggtacaaaggcaagtccatactcaacacattgacaactaccaaagcgccaagttatcaagtgacctacgatgacaatgatgatttgaatgtggtgtatgaagaagaaacagttacgacagtgtatccatcagtcgatatgaactttgtgaatgaaaaaggcggggctttcacaccggcgttaacttttagtggtaagtactatgcgcaaagtacgagtgcgtacttaagaaccgatttatatgacgtgacctcaaaaaataatggtaatgggcaatatacggtaagtattaataatggtagtatgccattgtcccaagaattattgaaaaaatataataatggacaaccaatcagtgctaccaacagattacagtttaatgttgataaattagccatcgaccaacaactaaaatatgttgacagcattcaattagacacagctcaaagtagcaatctgaaatcctatagatatgtgtacacgaacaatagctcactggttttcgacccaaatgtagcaccagcagaggttgaccttagttcagaatctcttaacttgcttaattttgattcagatggcacctatttttctaatgcaaataatagacttttttacacgcatttaggatatagtggcacaccaggagttaactatcttctcgtaatgtttctttttaacgccaaacctgcggataagtcaaaacttgtctacaaagtcactcgcaaacaagtcaccgaaaacttcgtggatgtcaacggtgccaaaatcactgcaccaacaggcttcacccaaggtaaccaagtaccaatgaacagtaacaccttcaagtacacagcggcaaaagctttaccagcgacgtatactacaggtggcaaagtctatacgttccaagggtggtataaagggaaaaccaagccaagtacgttgaacaaaacaacaactccaacgttcaatgcgacctttgatggcaatgacgatatgaccgccatgtataaggaagaaataccaacagctagtgtcacattaactcgaccaaaagaagtgattgatacgaataccaatgtaatctggacaacaacgatcacgaatactagcaaagcacccttacaaaatctcaccttgaaaaaagggcccaattggtcagctggtctgacgatcccgacctttatggaagtgacaccagaaggagaaacgacaaaatcaatcccagtaaatagtacactttggacagagggggttcctttaccaaatgccgttcctatcggcaaaaaagtttcagttgctttcacaactcgcgcaacagggaaaccaaacactgttttgaaagcagaagttgtagtatttggtggtattaaagatagtacagtggataacttcgtgagaattcgtccaaatgatcaagaagtagtcacaccaacgaccgaaggcttcatcagtgtgccaaccttcgacttcggccaagtgggcgttgcaggaactaagcaacaacacagcttgaaacaagccgcggattactacggtaacggcacacggaatccgtatctgcggattaagaaaacgcaacccaattggagcttaacagcgcaactgtcacaaccaaaatcagcgacagacagcttgcctacagcgacccgcttattattaggggcggcgcctgtctctagctttaccaattacaatcaaccaaccgagttgaaaaatacggtcggtaccacgagtgccattagcttaacagccaacaacacagcaacgagtattattgccaacaagcaattcacaggtagtaatgtttatcagttggacttcaccttcaataatgtcaaacttgaagtgccagccaatcaaggtgttaaagggcaacaatacaaggccgcagttacatggaacctagttacag

SEQ ID NO: 420 - protein, 1231 aa
VTIESSPTAESSAKEETQASSVKEETTKASTENSQVTTDTSQEEATKEAEKEEPQAEVEQAETPIIPKPKKINMKATYSFSAETYQFGFVNESGQLINPDIIPITYSYAKGSWKTDGYNRKWTSMVQGSASTVGNLKNVIMPATSVVMPPGPSYEGTQEVYTNFSIRIPKYYASASLYNREGKIDSTYPLPAIALAGTRPLSLTQSSVISALALTSKGDNVYTPRETFFGGDPAGVKFTNFLYRINDFDVKGNNIGYKTVSSPIYYHLTNRRVTENFVDTSGAKITPPSNFTQGKQTVINSDPYTFQQSGFLPETYKVGTKSYRFKGWYKGKTKTEPLATTKTPSYKVTYDDNDDLTVVYEEFSGYELPASTNQFGFVDEATNKLIAPDQVQMKYNLTLNENNKKTVMSSNLTGTDTATLKNLSVPVNYFEQYRVNTFYGASDITFTLPKRYKSINITKSDGKTDPAFPLPKIYNIDQVEMSHMPVTTYNKLKQLSGQTFGFNALADQPEFYTKTLFGTESGIDDPVNYYTMSGPVYYYLENRKVTENFVDTNGAKITPPTGFTQGKKTVITSDAYTFKQAGTLPDTYTTGGKTYKFKGWYKGKSILNTLTTTKAPSYQVTYDDNDDLNVVYEEETVTTVYPSVDMNFVNEKGGAFTPALTFSGKYYAQSTSAYLRTDLYDVTSKNNGNGQYTVSINNGSMPLSQELLKKYNNGQPISATNRLQFNVDKLAIDQQLKYVDSIQLDTAQSSNLKSYRYVYTNNSSLVFDPNVAPAEVDLSSESLNLLNFDSDGTYFSNANNRLFYTHLGYSGTPGVNYLLVMFLFNAKPADKSKLVYKVTRKQVTENFVDVNGAKITAPTGFTQGNQVPMNSNTFKYTAAKALPATYTTGGKVYTFQGWYKGKTKPSTLNKTTTPTFNATFDGNDDMTAMYKEEIPTASVTLTRPKEVIDTNTNVIWTTTITNTSKAPLQNLTLKKGPNWSAGLTIPTFMEVTPEGETTKSIPVNSTLWTEGVPLPNAVPIGKKVSVAFTTRATGKPNTVLKAEVVVFGGIKDSTVDNFVRIRPNDQEVVTPTTEGFISVPTFDFGQVGVAGTKQQHSLKQAADYYGNGTRNPYLRIKKTQPNWSLTAQLSQPKSATDSLPTATRLLLGAAPVSSFTNYNQPTELKNTVGTTSAISLTANNTATSIIANKQFTGSNVYQLDFTFNNVKLEVPANQGVKGQQYKAAVTWNLVT

SEQ ID NO: 421 - DNA, 363 bp; double-stranded, linear
aggagtaaattaatgaaaaaaagtgttataactagttctatgttagcggttttgttgtcgggatttctcgttacccctatttctgcttacgctttggaacgctctaagggaactactgaagaaacggtggcttcagaaacatctctaacggagcgacaaatgagtagcggtgtcactgaagaaatgaacccaagcatcataaattctcaagaggaaacagaaacaacgtccacttcctcaacctccgattccaccactgaagtttctacatcagaagtaacaactgttaatgatacagaanatagtagcgacgtactgaaactactttggnaacatcacnaagtaatgaggacacacctatag

SEQ ID NO: 422 - protein, 116 aa
MKKSVITSSMLAVLLSGFLVTPISAYALERSKGTTEETVASETSLTERQMSSGVTEEMNPSIINSQEETETTSTSSTSDSTTEVSTSEVTTVNDTEXSSDVLKLLWXHHXVMRTHL

SEQ ID NO: 423 - DNA, 179 bp; double-stranded, linear
ggaacgctctaagggaactactgaagaaacggtggcttcagaaacatctctaacggagcgacaaatgagtagcggtgtcactgaagaaatgaacccaagcatcataaattctcaagaggaaacagaaacaacgtccacttcctcaacctccgattccaccactgaagtttctacatcag

SEQ ID NO: 424 - protein, 59 aa
ERSKGTTEETVASETSLTERQMSSGVTEEMNPSIINSQEETETTSTSSTSDSTTEVSTS

SEQ ID NO: 425 - DNA, 888 bp; double-stranded, linear
taaataaaaatggataaggagtggcataatcttatgaaaaagttctccatacgaaaaattagtgctggttttttgtttctgattttagtaactttgatcgccggttttagcttgtctgcaaatgcagaagagtatatcgttcctgccgaaagtcattcacgacaaaaaagatcgttactggaccctgaggacagaagacaagaagtggcagatacaaccgaagcgccttttgcgtcaatcggaagaatcatttcccctgccagtaaaccaggctatatttctttaggaacaggctttgttgttggaaccaatacaattgtcaccaataatcatgtggctgaaagttttaagaatgccaaagtattaaatccgaatgccaaagatgatgcttggttttatccaggtcgagatggcagtgcgacaccatttggcaaattcaaagtgattgatgtagctttttccccgaatgcggatattgcggtagtgactgtcggcaaacaaaacgatcgtccagatggcccagagttgggagaaattttaacgccatttgttttgaaaaagtttgaatcttcagatacccatgtcacaatatcaggctatccaggtgagaaaaaccacacacaatggtctcatgaaaatgatttgtttacatctaactttacagacttagaaaatccattactattttatgatatcgatacaaccggcggtcaatctggttcaccaatctataatgatcaggttgaagtagttggtgttcattccaatggcggcattaagcaaacaggaaatcatggtcaaagactaaatgaagtgaattataactttattgttaatcgagtgaatgaagaagaaaataaacgtttatccgctgtgccagcagcgtaa

SEQ ID NO: 426 - protein, 284 aa
MKKFSIRKISAGFLFLILVTLIAGFSLSANAEEYIVPAESHSRQKRSLLDPEDRRQEVADTTEAPFASIGRIISPASKPGYISLGTGFVVGTNTIVTNNHVAESFKNAKVLNPNAKDDAWFYPGRDGSATPFGKFKVIDVAFSPNADIAVVTVGKQNDRPDGPELGEILTPFVLKKFESSDTHVTISGYPGEKNHTQWSHENDLFTSNFTDLENPLLFYDIDTTGGQSGSPIYNDQVEVVGVHSNGGIKQTGNHGQRLNEVNYNFIVNRVNEEENKRLSAVPAA

SEQ ID NO: 427 - DNA, 758 bp; double-stranded, linear
agagtatatcgttcctgccgaaagtcattcacgacaaaaaagatcgttactggaccctgaggacagaagacaagaagtggcagatacaaccgaagcgccttttgcgtcaatcggaagaatcatttcccctgccagtaaaccaggctatatttctttaggaacaggctttgttgttggaaccaatacaattgtcaccaataatcatgtggctgaaagttttaagaatgccaaagtattaaatccgaatgccaaagatgatgcttggttttatccaggtcgagatggcagtgcgacaccatttggcaaattcaaagtgattgatgtagctttttccccgaatgcggatattgcggtagtgactgtcggcaaacaaaacgatcgtccagatggcccagagttgggagaaattttaacgccatttgttttgaaaaagtttgaatcttcagatacccatgtcacaatatcaggctatccaggtgagaaaaaccacacacaatggtctcatgaaaatgatttgtttacatctaactttacagacttagaaaatccattactattttatgatatcgatacaaccggcggtcaatctggttcaccaatctataatgatcaggttgaagtagttggtgttcattccaatggcggcattaagcaaacaggaaatcatggtcaaagactaaatgaagtgaattataactttattgttaatcgagtgaatgaagaagaaaataaacgtttatccgctgtgccagcagcgt

SEQ ID NO: 428 - protein, 252 aa
EYIVPAESHSRQKRSLLDPEDRRQEVADTTEAPFASIGRIISPASKPGYISLGTGFVVGTNTIVTNNHVAESFKNAKVLNPNAKDDAWFYPGRDGSATPFGKFKVIDVAFSPNADIAVVTVGKQNDRPDGPELGEILTPFVLKKFESSDTHVTISGYPGEKNHTQWSHENDLFTSNFTDLENPLLFYDIDTTGGQSGSPIYNDQVEVVGVHSNGGIKQTGNHGQRLNEVNYNFIVNRVNEEENKRLSAVPAA

SEQ ID NO: 429 - DNA, 1803 bp; double-stranded, linear
tgatcaatacacttcgatacggtcgctttttttctagagaaagttgaatctttcaataataaaaagggatacactccatttggcatagtccttgctgataataaatcagtgtataaagcgctatcattttataggaggggttttatgaagggtttatcaaaaaagaaacgggtgtctacttggttagcgttaggaatcaccgtagtcagctgttttgcgttaagcagggaagtgcaagcaagtgttgaaagaacaaaagttgatgaatttgcaaatgttttagatgtgagtgcatcaccaaccgaacggacgaatggcgtatacgataccaattattttaataatttttctgatttaggtgcatggcatggctactatttacctgaaaaaagcaataaagagctactgggtggttttgcggggccattgattattgcggaagaatatccagtaaacttggcggcaagtttaaacaaattaacggtcaaaaataaaaaaacgggagaaacctatgatttaagccaaagcaaccgcatggacctgtcttattatcctgggcgcctagagcaaacctatgaattagacgatttaacgattcatttagctttaatttttgtcagcaatcgaacggcgcttatccaaacgacacttgaaaacactggtgaagagcccttgtcacttggagcaagctggacaggtgcggtctttgacaaaattcaagagggaacggaaaccttagatattggcactcgtttaactgctaaagacaatgacattcaagtgaattttggtgaagtcagagaaacgtggaattattttgctacgaaagacacaaaatatacgattcatcatgcggataaagtttcaacaaaaattgataatcggaattatacagcaaccgctgaaccaattgaattgaagcctaaacaaacgtacaacacctatacgacagaaagctatacttttacaaaagaagaagaggcaaaggaacaacaacaagcacccgaatataccaaaaatgcggcgcgctatttcaaagagaacaagcaaagatggcaaggatatctagataaaacgtttgatcaaaagaaaacagcagaatttcctgaatatcaaaatgcgctagtcaaatcgattgaaacgattaataccaattggcgaagtgcggcaggtgcctttaagcatgacgggattgttccgtccatgtcttataaatggtttattggtatgtgggcttgggattcgtggaaagcggatgtagcaacggctgattttaatcctgagttagctaaaaataatatgcgggccttgtttgattatcaaattcaaaaagatgataccgtacgtccacaagatgcaggagcgatcattgatgctgtcttttacaatcaagacagtgcgcgtggtggtgaaggtggcaactggaatgaacgaaattctaaaccaccattggctgcatgggcagtttggcatatttatcaagaaaccaaagataaggaatttttaaaagaaatgtatcccaaacttgtggcttatcataattggtggtataccaacagagaccacaataaaaatgggatagcagaatatggaagcatggtcagtgatgctcactggcaaaaagacgacaaggatcaaatcattaaagataaaaatggccacctaaagtggatgatgatgctgttattgaagcagccgcgtgggaaagtggcatggataacgctacacggtttgacaaagaaggtgtgggcaaaggcgacgttggagttaaagtttttgaaaacaaaaataaaggaaaagtag

SEQ ID NO: 430 - protein, 552 aa
MKGLSKKKRVSTWLALGITVVSCFALSREVQASVERTKVDEFANVLDVSASPTERTNGVYDTNYFNNFSDLGAWHGYYLPEKSNKELLGGFAGPLIIAEEYPVNLAASLNKLTVKNKKTGETYDLSQSNRMDLSYYPGRLEQTYELDDLTIHLALIFVSNRTALIQTTLENTGEEPLSLGASWTGAVFDKIQEGTETLDIGTRLTAKDNDIQVNFGEVRETWNYFATKDTKYTIHHADKVSTKIDNRNYTATAEPIELKPKQTYNTYTTESYTFTKEEEAKEQQQAPEYTKNAARYFKENKQRWQGYLDKTFDQKKTAEFPEYQNALVKSIETINTNWRSAAGAFKHDGIVPSMSYKWFIGMWAWDSWKADVATADFNPELAKNNMRALFDYQIQKDDTVRPQDAGAIIDAVFYNQDSARGGEGGNWNERNSKPPLAAWAVWHIYQETKDKEFLKEMYPKLVAYHNWWYTNRDHNKNGIAEYGSMVSDAHWQKDDKDQIIKDKNGHLKWMMMLLLKQPRGKVAWITLHGLTKKVWAKATLELKFLKTKIKEK

SEQ ID NO: 431 - DNA, 1515 bp; double-stranded, linear
tgatgaatttgcaaatgttttagatgtgagtgcatcaccaaccgaacggacgaatggcgtatacgataccaattattttaataatttttctgatttaggtgcatggcatggctactatttacctgaaaaaagcaataaagagctactgggtggttttgcggggccattgattattgcggaagaatatccagtaaacttggcggcaagtttaaacaaattaacggtcaaaaataaaaaaacgggagaaacctatgatttaagccaaagcaaccgcatggacctgtcttattatcctgggcgcctagagcaaacctatgaattagacgatttaacgattcatttagctttaatttttgtcagcaatcgaacggcgcttatccaaacgacacttgaaaacactggtgaagagcccttgtcacttggagcaagctggacaggtgcggtctttgacaaaattcaagagggaacggaaaccttagatattggcactcgtttaactgctaaagacaatgacattcaagtgaattttggtgaagtcagagaaacgtggaattattttgctacgaaagacacaaaatatacgattcatcatgcggataaagtttcaacaaaaattgataatcggaattatacagcaaccgctgaaccaattgaattgaagcctaaacaaacgtacaacacctatacgacagaaagctatacttttacaaaagaagaagaggcaaaggaacaacaacaagcacccgaatataccaaaaatgcggcgcgctatttcaaagagaacaagcaaagatggcaaggatatctagataaaacgtttgatcaaaagaaaacagcagaatttcctgaatatcaaaatgcgctagtcaaatcgattgaaacgattaataccaattggcgaagtgcggcaggtgcctttaagcatgacgggattgttccgtccatgtcttataaatggtttattggtatgtgggcttgggattcgtggaaagcggatgtagcaacggctgattttaatcctgagttagctaaaaataatatgcgggccttgtttgattatcaaattcaaaaagatgataccgtacgtccacaagatgcaggagcgatcattgatgctgtcttttacaatcaagacagtgcgcgtggtggtgaaggtggcaactggaatgaacgaaattctaaaccaccattggctgcatgggcagtttggcatatttatcaagaaaccaaagataaggaatttttaaaagaaatgtatcccaaacttgtggcttatcataattggtggtataccaacagagaccacaataaaaatgggatagcagaatatggaagcatggtcagtgatgctcactggcaaaaagacgacaaggatcaaatcattaaagataaaaatggccacctaaagtggatgatgatgctgttattgaagcagccgcgtgggaaagtggcatggataacgctacacggtttgacaaagaaggtgtgggcaaaggcgacgttggagttaaagtt

SEQ ID NO: 432 - protein, 504 aa
DEFANVLDVSASPTERTNGVYDTNYFNNFSDLGAWHGYYLPEKSNKELLGGFAGPLIIAEEYPVNLAASLNKLTVKNKKTGETYDLSQSNRMDLSYYPGRLEQTYELDDLTIHLALIFVSNRTALIQTTLENTGEEPLSLGASWTGAVFDKIQEGTETLDIGTRLTAKDNDIQVNFGEVRETWNYFATKDTKYTIHHADKVSTKIDNRNYTATAEPIELKPKQTYNTYTTESYTFTKEEEAKEQQQAPEYTKNAARYFKENKQRWQGYLDKTFDQKKTAEFPEYQNALVKSIETINTNWRSAAGAFKHDGIVPSMSYKWFIGMWAWDSWKADVATADFNPELAKNNMRALFDYQIQKDDTVRPQDAGAIIDAVFYNQDSARGGEGGNWNERNSKPPLAAWAVWHIYQETKDKEFLKEMYPKLVAYHNWWYTNRDHNKNGIAEYGSMVSDAHWQKDDKDQIIKDKNGHLKWMMMLLLKQPRGKVAWITLHGLTKKVWAKATLELK

SEQ ID NO: 433 - DNA, 411 bp; double-stranded, linear
taattcgatggagaaggtggtttagtgaaaagattttcattttttttactaattttacttgctttaacaggttgtaaatccggtgaaaaagaatttgatgaagaatctcttcaaaatctaaaggaaacgncacagtcttantcagaaacagaattacaaaatggtgacgttcgtttaaatgaatatatttctttgaaaggggagattgttgagagtgacagtcgttccagtttaataaaaaaaggtgatcgttttattttgaaaagtggttctagtaaatatcaagtttntaatgagcaaaagaaaaaattgaagattggtgacgaagtgacagtttacggagaatattacggctttttgaaagggacattaattgaaagtgaggagaatcatgattcagccacgaattag

SEQ ID NO: 434 - protein, 128 aa
VKRFSFFLLILLALTGCKSGEKEFDEESLQNLKETXQSXSETELQNGDVRLNEYISLKGEIVESDSRSSLIKKGDRFILKSGSSKYQVXNEQKKKLKIGDEVTVYGEYYGFLKGTLIESEENHDSATN

SEQ ID NO: 435 - DNA, 309 bp; double-stranded, linear
tgaagaatctcttcaaaatctaaaggaaacgncacagtcttantcagaaacagaattacaaaatggtgacgttcgtttaaatgaatatatttctttgaaaggggagattgttgagagtgacagtcgttccagtttaataaaaaaaggtgatcgttttattttgaaaagtggttctagtaaatatcaagtttntaatgagcaaaagaaaaaattgaagattggtgacgaagtgacagtttacggagaatattacggctttttgaaagggacattaattgaaagtgaggagaatcatgattcagccacgaa

SEQ ID NO: 436 - protein, 103 aa
EESLQNLKETXQSXSETELQNGDVRLNEYISLKGEIVESDSRSSLIKKGDRFILKSGSSKYQVXNEQKKKLKIGDEVTVYGEYYGFLKGTLIESEENHDSATN

SEQ ID NO: 437 - DNA, 366 bp; double-stranded, linear
tgagggggaaaaagtgtgttaaaaagaaaagtggggattgtcgcaggcgttttctgttcagctttgttactgacaggttgtggcaaaagtgcgaaagatgagttcattcaaggaatcggcaatcanaacgcacaagaatctggggtttgngatttctctatgtcaattagtgacatgaaattttcacaagaagatggtgcacaaacgaatcctatgattgggatgctcatcacgcaaatcaaagacgcatcgctttctggggaagattcaagtagatgccaaaaaagaaaaagcattcaacttagagatgaaattaaaagcgatgggaatggatgtaccgatttcattggttggatcgttagataa

SEQ ID NO: 438 - protein, 116 aa
VLKRKVGIVAGVFCSALLLTGCGKSAKDEFIQGIGNXNAQESGVXDFSMSISDMKFSQEDGAQTNPMIGMLITQIKDASLSGEDSSRCQKRKSIQLRDEIKSDGNGCTDFIGWIVR

SEQ ID NO: 439 - DNA, 272 bp; double-stranded, linear
gaaagatgagttcattcaaggaatcggcaatcanaacgcacaagaatctggggtttgngatttctctatgtcaattagtgacatgaaattttcacaagaagatggtgcacaaacgaatcctatgattgggatgctcatcacgcaaatcaaagacgcatcgctttctggggaagattcaagtagatgccaaaaaagaaaaagcattcaacttagagatgaaattaaaagcgatgggaatggatgtaccgatttcattggttggatcgttagat

SEQ ID NO: 440 - protein, 90 aa
KDEFIQGIGNXNAQESGVXDFSMSISDMKFSQEDGAQTNPMIGMLITQIKDASLSGEDSSRCQKRKSIQLRDEIKSDGNGCTDFIGWIVR

SEQ ID NO: 441 - DNA, 606 bp; double-stranded, linear
taaagaataccgagtaaaattttcggaaggctttttttcaaaaattgtatatgcaaaagaagtgcaacggaaaggagctcggaaatcgtgaataagctacctttacttattttattgttaggcggagtgttgcttgttagtggctgtcaaagccataaggaagaaaacaagtctagtaaagtatcgacagaagaaacgacagtgattgaaacagtagcaagggaacaatcgaaggaatcgtttacgagtgaagcaactaaaaaacagacagaaacaacgaaattagaagaaccagatcatgtaaaacttctagaagcttatggaaatgcgtatgcgaactttacaagtattaatgatcgcaatgaaaagctaaagcccctcatgactgaaaaatgtatcaaaaaaaatggaattgatgttaaaactggagtagcgttagtttccgtaggaaaggttacaacgatttataaaaatgatcaacatgaatatgctttacttttggattgtgaacaaaatggaacgcagacacgagtgttacttttggctaaggtgaagaacaataaaatttctgaaatgacctataattcagttaagcaagagtattag

SEQ ID NO: 442 - protein, 172 aa
VNKLPLLILLLGGVLLVSGCQSHKEENKSSKVSTEETTVIETVAREQSKESFTSEATKKQTETTKLEEPDHVKLLEAYGNAYANFTSINDRNEKLKPLMTEKCIKKNGIDVKTGVALVSVGKVTTIYKNDQHEYALLLDCEQNGTQTRVLLLAKVKNNKISEMTYNSVKQEY

SEQ ID NO: 443 - DNA, 442 bp; double-stranded, linear
agaaaacaagtctagtaaagtatcgacagaagaaacgacagtgattgaaacagtagcaagggaacaatcgaaggaatcgtttacgagtgaagcaactaaaaaacagacagaaacaacgaaattagaagaaccagatcatgtaaaacttctagaagcttatggaaatgcgtatgcgaactttacaagtattaatgatcgcaatgaaaagctaaagcccctcatgactgaaaaatgtatcaaaaaaaatggaattgatgttaaaactggagtagcgttagtttccgtaggaaaggttacaacgatttataaaaatgatcaacatgaatatgctttacttttggattgtgaacaaaatggaacgcagacacgagtgttacttttggctaaggtgaagaacaataaaatttctgaaatgacctataattcagttaagcaagagtat

SEQ ID NO: 444 - protein, 147 aa
ENKSSKVSTEETTVIETVAREQSKESFTSEATKKQTETTKLEEPDHVKLLEAYGNAYANFTSINDRNEKLKPLMTEKCIKKNGIDVKTGVALVSVGKVTTIYKNDQHEYALLLDCEQNGTQTRVLLLAKVKNNKISEMTYNSVKQEY

SEQ ID NO: 445 - DNA, 480 bp; double-stranded, linear
tgaataggcgtgaaaaagggaatgttagcgttttttgtcgtgctagcggttttatcattaactgcttgtcgggaaccaaaagnaaagaaagtaaccgcttcaacggaggcatcctctaaagttgaagagacgaatgaaaaaacgagtgaaacaattgataagacaaacgaacaagcgagcagcagtgtcgagtctaacgaatcagtgaaaaatgaagagccgacagctgatggaaacaatagtcagctaactgtagctgatttagatactacagcgattaatgctggcgattttactactttagttggaatatggaaaaatggtaaaggagagagtttgatcattcatcctgatggtagtacaaataccggaggaatgattacgaaggattcacctactgatgagtcgcgaccaattacaagcttaagtattaggtgggggcctactggtgctgcgctattattatataaaattggtgtt

SEQ ID NO: 446 - protein, 157 aa
VKKGMLAFFVVLAVLSLTACREPKXKKVTASTEASSKVEETNEKTSETIDKTNEQASSSVESNESVKNEEPTADGNNSQLTVADLDTTAINAGDFTTLVGIWKNGKGESLIIHPDGSTNTGGMITKDSPTDESRPITSLSIRWGPTGAALLLYKIGV

SEQ ID NO: 447 - DNA, 396 bp; double-stranded, linear
aagaaagtaaccgcttcaacggaggcatcctctaaagttgaagagacgaatgaaaaaacgagtgaaacaattgataagacaaacgaacaagcgagcagcagtgtcgagtctaacgaatcagtgaaaaatgaagagccgacagctgatggaaacaatagtcagctaactgtagctgatttagatactacagcgattaatgctggcgattttactactttagttggaatatggaaaaatggtaaaggagagagtttgatcattcatcctgatggtagtacaaataccggaggaatgattacgaaggattcacctactgatgagtcgcgaccaattacaagcttaagtattaggtgggggcctactggtgctgcgctattattatataaaattggtgtt

SEQ ID NO: 448 - protein, 132 aa
KKVTASTEASSKVEETNEKTSETIDKTNEQASSSVESNESVKNEEPTADGNNSQLTVADLDTTAINAGDFTTLVGIWKNGKGESLIIHPDGSTNTGGMITKDSPTDESRPITSLSIRWGPTGAALLLYKIGV

SEQ ID NO: 449 - DNA, 3963 bp; double-stranded, linear
tgaaacacaaggaggaaatttgtgaaaaagttgagctttaaaaaagtgaagtggggcatgcattttttaatggctgttgcgttgatagcgccaagtgttactagtacggcatatgcagtagaaacaacgagtcaacaaagttcagaagcagtaacaagtaccaccgattcaagtagaaaacaagaaccagtcattacacaggaaacaacagacatcaaacaagaagcaccaaatcaggctacgagtgacagtgtcaagcagtcacaagaaaccacagcaccaacagagacgacgaatttagaaacgtcaatcgctgaaaaagaagaaacgagcacgccgcaaaaaataacaattttaggtacgtcagatgttcatggtcaattatggaattggtcttatgaagatgataaagaactaccagttggtttgtcccaagtaagtacagtcgttaaccaagtccgggcacaaaacccagcaggcaccgttttaattgataatggcgacaatattcaaggcactattttaacagatgacttgtataataaagcgcctttagtgaatgaaaagacccatccaatgatcaccgccatgaatgtgatgaagtatgatgcaatggttttgggaaatcatgagtttaattttggtttaccgttaatcaaaaaaattcaacaagaagccacttttccaatcttgtctgcgaatacctacaataaggaagatggtcttcgttttgttgaagggactaccacgaaggaacttgattttaatcaagatgggcagccagatttaaaagttgggattatcggcttaacaattccgcacattcctttgtgggatggccctcgtgttacttcgcttaattttttacctttgaaagaagaagcagaaaaagcagttactgagttgaaagctaacgatcaggctgacattattgttgcctcgattcatgcgggacaacaaaatagtgatccggctgccagtgccgaccaagtaattgaaaatgtcgcggggattgatgcgtatattctgggtcatgaccacctttcttttaccaagcaaggagcagcgccgaatggaaaaactgtaccggtagggggaccgaaagatacggggacagaagttgtcaaaattgatctttcagttgctaaaaatgccgataagtgggaagtgcaagaaggtacagcaacgattgtaccaacaacgaatgttccagcagatgaagcagttaaggcagcgacaaaagaataccatgaaaaaacgcgagcgtttattcaggaggagatcggcacagcaacagctgattttttaccaaaacaagaaattaaaggaattcccgaagcacaattacaaccaacagcgatgatttctttaattaataacgttcaaaaagaagtaacgggcgcacaattaagtgcggcagcgctgtttaaatacgacagtaaattacctgcggggaagatttcctatgccacgatttttgatatctacaaatacccgaataccttagtgagtgttcccattaacggtgaaaacttactgaagtatttagaaaaacaaggggcgtactataaccaaacacagccagatgatttgaccattagttttaatccaaacattcgtgtatataactatgacatgatttctggagtggactacaagattgacatttcaaaaccagtgggtgaacgaattgtagatgcgaaaattgacggccaaccgctggatcctgccaaagaatatacgattgctatgaataattatcgttacggcggtttagctagccaagggattcaagtaggggaacctattaaaaattctgatccagaaaccttacgaggaatgattgttgattatattaagaaaaaaggaactcttgatccagaacaagaaatcgaacgaaattggtcaattattgggacaaattttgatgaaaaatggcgtgccaaagcaatcgaattagtgaatgacggcactcttcaaattccgacttctcctgatggacgtacaccaaacgccgccgctattacgaaacaagatgtccgtaatgcgggctttgatttagataatgcatataccattatgcacacaaatgacgttcatggccgactagaagcagggaaaggcgaattaggtatggcgcgtctaaaaacctttaaagaccaagaaaacccaaccttgatggtggatgcaggggatgttttccaaggattaccaatctccaatttctccaaaggcgcggatatggccaaagcaatgaatgaagttggttatgatgccatggcggtgggaaatcacgagtttgattttggtttagagattgcactaggttataaagaccaactgaattttccgattttatctagtaatacgtattacaaagatggcagtggacgggtttttgatccgtatacaatcgtagaaaaatccgggaaaaagtttgccattgtaggtgtgacgaccccagaaacagcaacgaaaacacacccgaaaaacgtagagaaggtgacatttaaagacccgattccagaagtagaagcagtgattaaggaaattaaagagaagtacgcggatatncaagctttcgtggttactgggcatttaggcgtagatgaaacgacgccgcatatctggcgtggtgatacgctagcagaaacccttagtcaaacatatcctgagttagatatcactgtgattgatggacattcgcatacagccgtcgaaagtggcaaacgttatggcaaagtgatctatgctcaaacaggtaattatttaaataatgttgggatcgtcacagcaccagagagtgaaccaactaagaaaacaacaaaattgatttcagcagcagagctgctagaattgccagaaaacccggcagttaaagccatcgttgatgaagcacgtacgaattttaacgctgaaaatgaaaaagtaattgtcgattatattccattcacattggatggacaacgagaaaatgtgcgcacacgagagaccaacttagggaatttgattggtgatgcgattatgtcatatggccaagacgcgtttagccaacctgctgattttgcagtaactaatggtggcggcattcgcgctgatattaaacaagggccaattaaagttggggatgtcattgctgtgttaccttttggcaatagcattgcgcaaattcaagtaaccggcgcccaagttaaagaaatgtttgaaatgtctgttcgttcgattccacaaaaagatgagaatggcacaattttactagatgatgctggccaaccaaaacttggcgcaaatggtggtttcctacatgtttcaagctccattcgtatccactatgattccacaaaaccaggtactcgcttggctagtgacgaaggcaatgaaacaggacaaacgattgtcggtagtcgcgtattaggaatagaaattaaaaatcggcaaacacaaaagtttgaaccattggatgagaagaaacaataccggatggctaccaatgatttcttagctgctggtggtgatggttacgatatgctaggtggtgaacgagaagaagggatttcactagattctgtcttaattgaatacttgaaaagtgcaaccagcttgcggttgtatcgtgcagcaacgacgattgatttagcacaatataaagaaccattcccaggcgaacgaattgtttctatttcggaagaagcttacaaagagttaatcggtggaggagagacgccaaaaccagatccaaaaccagacccgaaaccaacaccagaaacaccagtagcaaccaataaacaaaaccaagcgggagcaagacagagcaatccatccgtaacagagaagaaaaagtatggcggctttttacctaaaacgggtacagaaacagaaacgcttgcattatatggtttactgttcgttggactttcttcttctggctggtatatttataaacgacgtaacaaagctagttag

SEQ ID NO: 450 - protein, 1313 aa
VKKLSFKKVKWGMHFLMAVALIAPSVTSTAYAVETTSQQSSEAVTSTTDSSRKQEPVITQETTDIKQEAPNQATSDSVKQSQETTAPTETTNLETSIAEKEETSTPQKITILGTSDVHGQLWNWSYEDDKELPVGLSQVSTVVNQVRAQNPAGTVLIDNGDNIQGTILTDDLYNKAPLVNEKTHPMITAMNVMKYDAMVLGNHEFNFGLPLIKKIQQEATFPILSANTYNKEDGLRFVEGTTTKELDFNQDGQPDLKVGIIGLTIPHIPLWDGPRVTSLNFLPLKEEAEKAVTELKANDQADIIVASIHAGQQNSDPAASADQVIENVAGIDAYILGHDHLSFTKQGAAPNGKTVPVGGPKDTGTEVVKIDLSVAKNADKWEVQEGTATIVPTTNVPADEAVKAATKEYHEKTRAFIQEEIGTATADFLPKQEIKGIPEAQLQPTAMISLINNVQKEVTGAQLSAAALFKYDSKLPAGKISYATIFDIYKYPNTLVSVPINGENLLKYLEKQGAYYNQTQPDDLTISFNPNIRVYNYDMISGVDYKIDISKPVGERIVDAKIDGQPLDPAKEYTIAMNNYRYGGLASQGIQVGEPIKNSDPETLRGMIVDYIKKKGTLDPEQEIERNWSIIGTNFDEKWRAKAIELVNDGTLQIPTSPDGRTPNAAAITKQDVRNAGFDLDNAYTIMHTNDVHGRLEAGKGELGMARLKTFKDQENPTLMVDAGDVFQGLPISNFSKGADMAKAMNEVGYDAMAVGNHEFDFGLEIALGYKDQLNFPILSSNTYYKDGSGRVFDPYTIVEKSGKKFAIVGVTTPETATKTHPKNVEKVTFKDPIPEVEAVIKEIKEKYADXQAFVVTGHLGVDETTPHIWRGDTLAETLSQTYPELDITVIDGHSHTAVESGKRYGKVIYAQTGNYLNNVGIVTAPESEPTKKTTKLISAAELLELPENPAVKAIVDEARTNFNAENEKVIVDYIPFTLDGQRENVRTRETNLGNLIGDAIMSYGQDAFSQPADFAVTNGGGIRADIKQGPIKVGDVIAVLPFGNSIAQIQVTGAQVKEMFEMSVRSIPQKDENGTILLDDAGQPKLGANGGFLHVSSSIRIHYDSTKPGTRLASDEGNETGQTIVGSRVLGIEIKNRQTQKFEPLDEKKQYRMATNDFLAAGGDGYDMLGGEREEGISLDSVLIEYLKSATSLRLYRAATTIDLAQYKEPFPGERIVSISEEAYKELIGGGETPKPDPKPDPKPTPETPVATNKQNQAGARQSNPSVTEKKKYGGFLPKTGTETETLALYGLLFVGLSSSGWYIYKRRNKAS

SEQ ID NO: 451 - DNA, 1883 bp; double-stranded, linear
acaaagttcagaagcagtaacaagtaccaccgattcaagtagaaaacaagaaccagtcattacacaggaaacaacagacatcaaacaagaagcaccaaatcaggctacgagtgacagtgtcaagcagtcacaagaaaccacagcaccaacagagacgacgaatttagaaacgtcaatcgctgaaaaagaagaaacgagcacgccgcaaaaaataacaattttaggtacgtcagatgttcatggtcaattatggaattggtcttatgaagatgataaagaactaccagttggtttgtcccaagtaagtacagtcgttaaccaagtccgggcacaaaacccagcaggcaccgttttaattgataatggcgacaatattcaaggcactattttaacagatgacttgtataataaagcgcctttagtgaatgaaaagacccatccaatgatcaccgccatgaatgtgatgaagtatgatgcaatggttttgggaaatcatgagtttaattttggtttaccgttaatcaaaaaaattcaacaagaagccacttttccaatcttgtctgcgaatacctacaataaggaagatggtcttcgttttgttgaagggactaccacgaaggaacttgattttaatcaagatgggcagccagatttaaaagttgggattatcggcttaacaattccgcacattcctttgtgggatggccctcgtgttacttcgcttaattttttacctttgaaagaagaagcagaaaaagcagttactgagttgaaagctaacgatcaggctgacattattgttgcctcgattcatgcgggacaacaaaatagtgatccggctgccagtgccgaccaagtaattgaaaatgtcgcggggattgatgcgtatattctgggtcatgaccacctttcttttaccaagcaaggagcagcgccgaatggaaaaactgtaccggtagggggaccgaaagatacggggacagaagttgtcaaaattgatctttcagttgctaaaaatgccgataagtgggaagtgcaagaaggtacagcaacgattgtaccaacaacgaatgttccagcagatgaagcagttaaggcagcgacaaaagaataccatgaaaaaacgcgagcgtttattcaggaggagatcggcacagcaacagctgattttttaccaaaacaagaaattaaaggaattcccgaagcacaattacaaccaacagcgatgatttctttaattaataacgttcaaaaagaagtaacgggcgcacaattaagtgcggcagcgctgtttaaatacgacagtaaattacctgcggggaagatttcctatgccacgatttttgatatctacaaatacccgaataccttagtgagtgttcccattaacggtgaaaacttactgaagtatttagaaaaacaaggggcgtactataaccaaacacagccagatgatttgaccattagttttaatccaaacattcgtgtatataactatgacatgatttctggagtggactacaagattgacatttcaaaaccagtgggtgaacgaattgtagatgcgaaaattgacggccaaccgctggatcctgccaaagaatatacgattgctatgaataattatcgttacggcggtttagctagccaagggattcaagtaggggaacctattaaaaattctgatccagaaaccttacgaggaatgattgttgattatattaagaaaaaaggaactcttgatccagaacaagaaatcgaacgaaattggtcaattattgggacaaattttgatgaaaaatggcgtgccaaagcaatcgaattagtgaatgacggcactcttcaaattccgacttctcctgatggacgtacaccaaacgccg

SEQ ID NO: 452 - protein, 627 aa
QSSEAVTSTTDSSRKQEPVITQETTDIKQEAPNQATSDSVKQSQETTAPTETTNLETSIAEKEETSTPQKITILGTSDVHGQLWNWSYEDDKELPVGLSQVSTVVNQVRAQNPAGTVLIDNGDNIQGTILTDDLYNKAPLVNEKTHPMITAMNVMKYDAMVLGNHEFNFGLPLIKKIQQEATFPILSANTYNKEDGLRFVEGTTTKELDFNQDGQPDLKVGIIGLTIPHIPLWDGPRVTSLNFLPLKEEAEKAVTELKANDQADIIVASIHAGQQNSDPAASADQVIENVAGIDAYILGHDHLSFTKQGAAPNGKTVPVGGPKDTGTEVVKIDLSVAKNADKWEVQEGTATIVPTTNVPADEAVKAATKEYHEKTRAFIQEEIGTATADFLPKQEIKGIPEAQLQPTAMISLINNVQKEVTGAQLSAAALFKYDSKLPAGKISYATIFDIYKYPNTLVSVPINGENLLKYLEKQGAYYNQTQPDDLTISFNPNIRVYNYDMISGVDYKIDISKPVGERIVDAKIDGQPLDPAKEYTIAMNNYRYGGLASQGIQVGEPIKNSDPETLRGMIVDYIKKKGTLDPEQEIERNWSIIGTNFDEKWRAKAIELVNDGTLQIPTSPDGRTPNA

SEQ ID NO: 453 - DNA, 3963 bp; double-stranded, linear; identical to SEQ ID NO: 449

SEQ ID NO: 454 - protein, 1313 aa; identical to SEQ ID NO: 450

SEQ ID NO: 455 - DNA, 1924 bp; double-stranded, linear
tgaaaaatggcgtgccaaagcaatcgaattagtgaatgacggcactcttcaaattccgacttctcctgatggacgtacaccaaacgccgccgctattacgaaacaagatgtccgtaatgcgggctttgatttagataatgcatataccattatgcacacaaatgacgttcatggccgactagaagcagggaaaggcgaattaggtatggcgcgtctaaaaacctttaaagaccaagaaaacccaaccttgatggtggatgcaggggatgttttccaaggattaccaatctccaatttctccaaaggcgcggatatggccaaagcaatgaatgaagttggttatgatgccatggcggtgggaaatcacgagtttgattttggtttagagattgcactaggttataaagaccaactgaattttccgattttatctagtaatacgtattacaaagatggcagtggacgggtttttgatccgtatacaatcgtagaaaaatccgggaaaaagtttgccattgtaggtgtgacgaccccagaaacagcaacgaaaacacacccgaaaaacgtagagaaggtgacatttaaagacccgattccagaagtagaagcagtgattaaggaaattaaagagaagtacgcggatatncaagctttcgtggttactgggcatttaggcgtagatgaaacgacgccgcatatctggcgtggtgatacgctagcagaaacccttagtcaaacatatcctgagttagatatcactgtgattgatggacattcgcatacagccgtcgaaagtggcaaacgttatggcaaagtgatctatgctcaaacaggtaattatttaaataatgttgggatcgtcacagcaccagagagtgaaccaactaagaaaacaacaaaattgatttcagcagcagagctgctagaattgccagaaaacccggcagttaaagccatcgttgatgaagcacgtacgaattttaacgctgaaaatgaaaaagtaattgtcgattatattccattcacattggatggacaacgagaaaatgtgcgcacacgagagaccaacttagggaatttgattggtgatgcgattatgtcatatggccaagacgcgtttagccaacctgctgattttgcagtaactaatggtggcggcattcgcgctgatattaaacaagggccaattaaagttggggatgtcattgctgtgttaccttttggcaatagcattgcgcaaattcaagtaaccggcgcccaagttaaagaaatgtttgaaatgtctgttcgttcgattccacaaaaagatgagaatggcacaattttactagatgatgctggccaaccaaaacttggcgcaaatggtggtttcctacatgtttcaagctccattcgtatccactatgattccacaaaaccaggtactcgcttggctagtgacgaaggcaatgaaacaggacaaacgattgtcggtagtcgcgtattaggaatagaaattaaaaatcggcaaacacaaaagtttgaaccattggatgagaagaaacaataccggatggctaccaatgatttcttagctgctggtggtgatggttacgatatgctaggtggtgaacgagaagaagggatttcactagattctgtcttaattgaatacttgaaaagtgcaaccagcttgcggttgtatcgtgcagcaacgacgattgatttagcacaatataaagaaccattcccaggcgaacgaattgtttctatttcggaagaagcttacaaagagttaatcggtggaggagagacgccaaaaccagatccaaaaccagacccgaaaccaacaccagaaacaccagtagcaaccaataaacaaaaccaagcgggagcaagacagagcaatccatccgtaacagagaagaaaaagtatggcggcttt

SEQ ID NO: 456 - protein, 641 aa
EKWRAKAIELVNDGTLQIPTSPDGRTPNAAAITKQDVRNAGFDLDNAYTIMHTNDVHGRLEAGKGELGMARLKTFKDQENPTLMVDAGDVFQGLPISNFSKGADMAKAMNEVGYDAMAVGNHEFDFGLEIALGYKDQLNFPILSSNTYYKDGSGRVFDPYTIVEKSGKKFAIVGVTTPETATKTHPKNVEKVTFKDPIPEVEAVIKEIKEKYADXQAFVVTGHLGVDETTPHIWRGDTLAETLSQTYPELDITVIDGHSHTAVESGKRYGKVIYAQTGNYLNNVGIVTAPESEPTKKTTKLISAAELLELPENPAVKAIVDEARTNFNAENEKVIVDYIPFTLDGQRENVRTRETNLGNLIGDAIMSYGQDAFSQPADFAVTNGGGIRADIKQGPIKVGDVIAVLPFGNSIAQIQVTGAQVKEMFEMSVRSIPQKDENGTILLDDAGQPKLGANGGFLHVSSSIRIHYDSTKPGTRLASDEGNETGQTIVGSRVLGIEIKNRQTQKFEPLDEKKQYRMATNDFLAAGGDGYDMLGGEREEGISLDSVLIEYLKSATSLRLYRAATTIDLAQYKEPFPGERIVSISEEAYKELIGGGETPKPDPKPDPKPTPETPVATNKQNQAGARQSNPSVTEKKKYGGF

SEQ ID NO: 457 - DNA, 6168 bp; double-stranded, linear
taaaataaaaaattggtacgaagtgaacgttctcttctatgtgtcgttagtagaggaaggatgaaagaaatgagaaagaatggtccaatggtaaaccgttggctctacgggttgatgtgtttgttacttgttctaaattatggcacaccactcatggctttggcggaagaggttaacagcgatggccagttaacgttaggagaagtgaagcaaaccagccagcaagaaatgaccttagcgcttcaaggaaaagcacaaccagtaacacaagaggttgtagtgcattatagtgccaatgtgtcaatcaaagctgcacattgggcagcgcccaataatacgcgcaagattcaagtggatgaccagaagaaacagattcaaattgaattgaatcagcaagcgttagcagatacgttagtcttaacgttgaaccctacagctacagaagatgtgacgttttcttatggacaacagcaacgagcgttgacgttaaagactggtactgatccgacagaatcaacggcaatcacgagttcgccagccgcatcagcgaatgaaggttcaacagaagaagcatctacaaactcctctgttcctcgttcgtccgaagaaactgtcgccagcacgacaaaagcgatagaaagtaaaacaactgaatcgacgactgtcaaaccgcgcgtagcaggaccaacagatatcagtgattattttacaggtgatgaaacaacgattatcgataattttgaagatccgatttatttaaatcctgatggaacaccagcaacaccgccgtataaagaagatgtgaccattcattggaactttaactggtcgattccagaagatgtgcgagaacaaatgaaagcaggcgattacttcgagtttcaattacctggcaatttgaaacctaataaaccaggttcaggtgatttagttgatgcagaaggcaatgtctatggaacctacacaattagtgaagatggtacggttcgttttacctttaatgagcgaatcacgtctgaaagtgacattcacggggacttttctttagatactcatttgaatgattcagatgggcggggcccaggagattgggtgattgatattcctacacaagaagatttgccgcctgtagtgattccaattgtcccagataccgaacaacaaattgataaacaaggccattttgatcgaacgcccaatcctagtgcgattacttggacggtagatatcaatcaagcgatgaaagatcaaacaaatccaactgtgacggaaacatggccaacagggaatacctttaagtccgtgaaagtctatgagttagtgatgaatcttgatggaacaattaaagaagtgggtcgcgaacttagtccagatgaatataccgttgataaaaatggcaatgtgacgattaaaggtgacaccaacaaagcgtatcgtcttgagtaccaaacgacgattgacgaggcggttattccagatggcggcggcgatgtgccttttaaaaatcacgcgacgttaacaagtgataataatccaaatgggttagatgctgaagcaactgttaccgccacatatggcaaaatgttagacaagcgcaatatagattacgacgaagccaatcaagaattcacttgggaaattaactacaactatggtgaacaaaccattccaaaagaccaagcagtcattacagacacaatgggggataatttaacgtttgaaccagattctttacatttatattcagtgacatttgatgacaaaggaaatgaagtcgttggagcagaacttgtggaaggaaaagattacaaagtggtaatcaacggagacggttcctttgcaattgactttttacatgatgtgactggcgcagtcaagattgattataaaaccaaagttgatggaattgtcgaaggcgatgttgccgtgaataatcgtgtggatgttggcactggtcagcattcagaagatgatggcacagccagtcaacaaaatattattaaaaacactggtgcagttgattatcaaaattcaacgattggttggacgttagctgtgaatcaaaataattatttgatggaaaatgccgtgattacggatacgtacgaaccagttcctggcttaactatggtacccaattcgttggttgtcaaagatacaaccactggtgctcagttgacgttaggcaaggatttcatggtagaaataactcgtaatgcagatggtgaaacaggctttaaggtaagttttataggggcgtatgccaaaacaagtgatgccttccacataacttatactacctttttcgatgttaccgagttagacgctaacaatcctgcgttggaccattatcgaaataccgctgccattgattggacggatgaagcaggaaacaatcatcattcagaagatagtaaaccgtttaaacctttacctgcttttgatttaaatgcgcaaaaaagcggtgtttacaatgccgtcaccaaagaaatcacttggacgattgcggttaatttaagtaataatcgtttagtcgacgcctttttgacggatccaattttaaccaatcaaacctatttggctgggagcttgaaagtctatgaaggcaatacaaagccagatggttcggttgaaaaagtgaaaccaacgcaaccgttgacggatatcacaatggaagaaccaagcgagaaaaaccaaaatacttggcgtgttgattttcctaatgatagtcgtacgtatgtgattgaatttaagacgtctgttgatgaaaaagttatcgaaggttcggctagttatgacaataccgcatcttatacaaaccaaggttcttcacgtgatgtgacaggaaaagtttctattcaacatggtggcgaatcagtgaaaaaaggtggcgaataccacaaagatgatccagatcatgtgtactggcatgtaatgatcaatggcgcccaatcggttttagacgatgtggttattactgatacaccctcaccaaaccaagtgctagatcccgagtcattggtgatttacggtaccaacgtaacagaagacggaactattacgccagataaatctgttattttagaagaaggaaaagattacacactggaagttaccaccgataatgaaacaggacaacaaaaaattgtcgttaaaatggcccatattgaagcaccttattatatggaatatcgtagtttagtgacttcttcagcggcggggagtacagacacggtatccaaccaagtgtcaattactggaaatggttcagaagtcgttcatggggatgacaatggcgatgtggtcgttgacattgatcacagtggcgggcatgccacagggactaaaggcaaaattcagctgaagaaaacagccatggatgagacgactattttagcaggcgcccatttccaaatttgggaccaagctaaaacacaagtcctacgtgaaggtacagtagatgccaccggggttatcacatttggtgggttgccacaagggcaatacattttggtggagacaaaagcaccagaaggctatacagtttcggacgaattagctaaaggccgagtcattactattgatgaagaaacttcagccgaaggagcacaaccaaccattattaaaaacgatgtcaataaagtatttttagaaaaaatggatgagaagggtaaaaagttagtcaatgctcgctttaaattagagcatgccgtaaccacgccgtttactcattgggaagaagttccccttgcgccggatcgaaccaacgcgaatggccagttagaggtggatagtttaaaaccagggctttatcagttcacagaaatcgaagcaccgacaggctatcttttagacacgacccccaaacgattcatcgtgacacaaaatacgagcggacaaattcgtgatgttcatgtcaaaatgcttaattaccaaggttctgctgaactaattaaaaaagaccaagcaggcaatccattagcaggtgctgaattttcagtccttgacaccacaggacaagcagttcgagaacacttagtttcggatgcaaacggaaaagtcacagtgacggatttagccccaggaaaatatcaatttgtggaaaccaaagcgccagcagggtaccttttaaacactgaaccaagtgctttcacgattgcagcaagcgatcggggcaaaccagcaacagttatagcaacggctaactttgttaactatcaaggcacggctaaattaatcaaaaaagatgtgaatggacacttattaagtggtgcgacatttaaagtgcttgatgcgaagggagaaacgattcaaacaggcttgacgacaaataatcaaggggaaattgttgcagagcacttagccccaggaaaatatcgctttgtagaaaccaaagcgccaacaggctatttattaaataccacgccagtcccatttgaaattgctgagaaaaatgctggtaaaccagcggtcgtggttgctagtgacaactttgtgagttacaaaggggctttccaaatcgtgaaaacgaatagcgcagaccaaccattagcaggtgctgtttttgaattatatgatcacaataaacaatcattagggattacagcaacgagtggcaaagatggcaaaattatctttagagacttggcgccaggtacctattattacaaagaaatcaaagcaccaaaattaccagatggcgcagattatattatttatcctgaattagtaaaagtagaaattcgtggtgatttcaaaggtgatccggagattttccaattaggggccttcgccaatttcaaaggacgcgccgtctttaagaaaattgatgccaatgcgaacccacttccaggaacgatttttaaattgtatcgaatcgaaaacggggaaaaaatctttgaaagagaagtaactgctgaaaaagatggttcattggctatggaggatttaggtgctggtagctatgaattagatgaactggatgcaacggatggctatatcgtcaataaacaacccatttattttgtagtgaagaagaattcaaatgataaacaaccactagatgagttagagtttgtaaattatcaagcagaagtaatgggacgtaaagtcaacgagcaaggtcaaaccttagcgggtgcagtttttgcaatttacaatgccgatgagcagaatcagccccaaggttcaccgataacattcttgaatcgtgcaggagaaaaagtttctgaaataacaacggataagactggcgaaatttacgctaaagggctaaatgaagggcattacgttttagtggaaacgaaagcaccaacaggctatctgttagacacaacgctacatccatttgatgtaaccgcccaattaggaaaagagcagccaattgctttaggcgatcttatcaattatcaaggaactgctcaattaaccaaagaaaacgaaacaggtgaagcattggcaggtgcggtgtttaaggtcattgatgaaacagggcaaaccgtagatggacaaaccaatctgatgtctgacaagcaaggcaaagtcattgcgaaaaacttagcaccgggaacgtatcgttttgtggagacacaagcgccaactagctatcttcttaatgaaacgccaagcgcaagctttacgattgccaaagacaaccaaggcaaaccagccactgtggtacttaaagcaccttttattaattaccaaggtgctgccaagctggtgaaaattgatcagcaaaagaatgccttagcaggtgctgaatttaaagtgacagatgcagagacagggcaaactgtcgctcgttcattacgttctgacaaccaagggttagttcaagtgaaccacttacaaccaggaaaatatacctttgtggaaacaaaagcaccggatggttaccaactgtctaagcaagctgtcgcattcactattgcggcaacagcgaaagacaaacctgaactcgtgaatgcgggcacgtttgttaacgagaaacaacctgtatccaaaaaaacaaaaccaaatcagccaacaacgaaacaagcagctagagagacaggttggcttggtttaccgaaaaccaacacacaagtcaattacttctttgtctttatcggcctcatgttggtcggtttggcaagttggctcttctataaaaagagcaagaaataa

SEQ ID NO: 458 - protein, 2032 aa
MRKNGPMVNRWLYGLMCLLLVLNYGTPLMALAEEVNSDGQLTLGEVKQTSQQEMTLALQGKAQPVTQEVVVHYSANVSIKAAHWAAPNNTRKIQVDDQKKQIQIELNQQALADTLVLTLNPTATEDVTFSYGQQQRALTLKTGTDPTESTAITSSPAASANEGSTEEASTNSSVPRSSEETVASTTKAIESKTTESTTVKPRVAGPTDISDYFTGDETTIIDNFEDPIYLNPDGTPATPPYKEDVTIHWNFNWSIPEDVREQMKAGDYFEFQLPGNLKPNKPGSGDLVDAEGNVYGTYTISEDGTVRFTFNERITSESDIHGDFSLDTHLNDSDGRGPGDWVIDIPTQEDLPPVVIPIVPDTEQQIDKQGHFDRTPNPSAITWTVDINQAMKDQTNPTVTETWPTGNTFKSVKVYELVMNLDGTIKEVGRELSPDEYTVDKNGNVTIKGDTNKAYRLEYQTTIDEAVIPDGGGDVPFKNHATLTSDNNPNGLDAEATVTATYGKMLDKRNIDYDEANQEFTWEINYNYGEQTIPKDQAVITDTMGDNLTFEPDSLHLYSVTFDDKGNEVVGAELVEGKDYKVVINGDGSFAIDFLHDVTGAVKIDYKTKVDGIVEGDVAVNNRVDVGTGQHSEDDGTASQQNIIKNTGAVDYQNSTIGWTLAVNQNNYLMENAVITDTYEPVPGLTMVPNSLVVKDTTTGAQLTLGKDFMVEITRNADGETGFKVSFIGAYAKTSDAFHITYTTFFDVTELDANNPALDHYRNTAAIDWTDEAGNNHHSEDSKPFKPLPAFDLNAQKSGVYNAVTKEITWTIAVNLSNNRLVDAFLTDPILTNQTYLAGSLKVYEGNTKPDGSVEKVKPTQPLTDITMEEPSEKNQNTWRVDFPNDSRTYVIEFKTSVDEKVIEGSASYDNTASYTNQGSSRDVTGKVSIQHGGESVKKGGEYHKDDPDHVYWHVMINGAQSVLDDVVITDTPSPNQVLDPESLVIYGTNVTEDGTITPDKSVILEEGKDYTLEVTTDNETGQQKIVVKMAHIEAPYYMEYRSLVTSSAAGSTDTVSNQVSITGNGSEVVHGDDNGDVVVDIDHSGGHATGTKGKIQLKKTAMDETTILAGAHFQIWDQAKTQVLREGTVDATGVITFGGLPQGQYILVETKAPEGYTVSDELAKGRVITIDEETSAEGAQPTIIKNDVNKVFLEKMDEKGKKLVNARFKLEHAVTTPFTHWEEVPLAPDRTNANGQLEVDSLKPGLYQFTEIEAPTGYLLDTTPKRFIVTQNTSGQIRDVHVKMLNYQGSAELIKKDQAGNPLAGAEFSVLDTTGQAVREHLVSDANGKVTVTDLAPGKYQFVETKAPAGYLLNTEPSAFTIAASDRGKPATVIATANFVNYQGTAKLIKKDVNGHLLSGATFKVLDAKGETIQTGLTTNNQGEIVAEHLAPGKYRFVETKAPTGYLLNTTPVPFEIAEKNAGKPAVVVASDNFVSYKGAFQIVKTNSADQPLAGAVFELYDHNKQSLGITATSGKDGKIIFRDLAPGTYYYKEIKAPKLPDGADYIIYPELVKVEIRGDFKGDPEIFQLGAFANFKGRAVFKKIDANANPLPGTIFKLYRIENGEKIFEREVTAEKDGSLAMEDLGAGSYELDELDATDGYIVNKQPIYFVVKKNSNDKQPLDELEFVNYQAEVMGRKVNEQGQTLAGAVFAIYNADEQNQPQGSPITFLNRAGEKVSEITTDKTGEIYAKGLNEGHYVLVETKAPTGYLLDTTLHPFDVTAQLGKEQPIALGDLINYQGTAQLTKENETGEALAGAVFKVIDETGQTVDGQTNLMSDKQGKVIAKNLAPGTYRFVETQAPTSYLLNETPSASFTIAKDNQGKPATVVLKAPFINYQGAAKLVKIDQQKNALAGAEFKVTDAETGQTVARSLRSDNQGLVQVNHLQPGKYTFVETKAPDGYQLSKQAVAFTIAATAKDKPELVNAGTFVNEKQPVSKKTKPNQPTTKQAARETGWLGLPKTNTQVNYFFVFIGLMLVGLASWLFYKKSKK

SEQ ID NO: 459 - DNA, 2212 bp; double-stranded, linear
ggaagaggttaacagcgatggccagttaacgttaggagaagtgaagcaaaccagccagcaagaaatgaccttagcgcttcaaggaaaagcacaaccagtaacacaagaggttgtagtgcattatagtgccaatgtgtcaatcaaagctgcacattgggcagcgcccaataatacgcgcaagattcaagtggatgaccagaagaaacagattcaaattgaattgaatcagcaagcgttagcagatacgttagtcttaacgttgaaccctacagctacagaagatgtgacgttttcttatggacaacagcaacgagcgttgacgttaaagactggtactgatccgacagaatcaacggcaatcacgagttcgccagccgcatcagcgaatgaaggttcaacagaagaagcatctacaaactcctctgttcctcgttcgtccgaagaaactgtcgccagcacgacaaaagcgatagaaagtaaaacaactgaatcgacgactgtcaaaccgcgcgtagcaggaccaacagatatcagtgattattttacaggtgatgaaacaacgattatcgataattttgaagatccgatttatttaaatcctgatggaacaccagcaacaccgccgtataaagaagatgtgaccattcattggaactttaactggtcgattccagaagatgtgcgagaacaaatgaaagcaggcgattacttcgagtttcaattacctggcaatttgaaacctaataaaccaggttcaggtgatttagttgatgcagaaggcaatgtctatggaacctacacaattagtgaagatggtacggttcgttttacctttaatgagcgaatcacgtctgaaagtgacattcacggggacttttctttagatactcatttgaatgattcagatgggcggggcccaggagattgggtgattgatattcctacacaagaagatttgccgcctgtagtgattccaattgtcccagataccgaacaacaaattgataaacaaggccattttgatcgaacgcccaatcctagtgcgattacttggacggtagatatcaatcaagcgatgaaagatcaaacaaatccaactgtgacggaaacatggccaacagggaatacctttaagtccgtgaaagtctatgagttagtgatgaatcttgatggaacaattaaagaagtgggtcgcgaacttagtccagatgaatataccgttgataaaaatggcaatgtgacgattaaaggtgacaccaacaaagcgtatcgtcttgagtaccaaacgacgattgacgaggcggttattccagatggcggcggcgatgtgccttttaaaaatcacgcgacgttaacaagtgataataatccaaatgggttagatgctgaagcaactgttaccgccacatatggcaaaatgttagacaagcgcaatatagattacgacgaagccaatcaagaattcacttgggaaattaactacaactatggtgaacaaaccattccaaaagaccaagcagtcattacagacacaatgggggataatttaacgtttgaaccagattctttacatttatattcagtgacatttgatgacaaaggaaatgaagtcgttggagcagaacttgtggaaggaaaagattacaaagtggtaatcaacggagacggttcctttgcaattgactttttacatgatgtgactggcgcagtcaagattgattataaaaccaaagttgatggaattgtcgaaggcgatgttgccgtgaataatcgtgtggatgttggcactggtcagcattcagaagatgatggcacagccagtcaacaaaatattattaaaaacactggtgcagttgattatcaaaattcaacgattggttggacgttagctgtgaatcaaaataattatttgatggaaaatgccgtgattacggatacgtacgaaccagttcctggcttaactatggtacccaattcgttggttgtcaaagatacaaccactggtgctcagttgacgttaggcaaggatttcatggtagaaataactcgtaatgcagatggtgaaacaggctttaaggtaagttttataggggcgtatgccaaaacaagtgatgccttccacataacttatactacctttttcgatgttaccgagttagacgctaacaatcctgcgttggaccattatcgaaataccgctgccattgattgg

SEQ ID NO: 460 - protein, 737 aa
EEVNSDGQLTLGEVKQTSQQEMTLALQGKAQPVTQEVVVHYSANVSIKAAHWAAPNNTRKIQVDDQKKQIQIELNQQALADTLVLTLNPTATEDVTFSYGQQQRALTLKTGTDPTESTAITSSPAASANEGSTEEASTNSSVPRSSEETVASTTKAIESKTTESTTVKPRVAGPTDISDYFTGDETTIIDNFEDPIYLNPDGTPATPPYKEDVTIHWNFNWSIPEDVREQMKAGDYFEFQLPGNLKPNKPGSGDLVDAEGNVYGTYTISEDGTVRFTFNERITSESDIHGDFSLDTHLNDSDGRGPGDWVIDIPTQEDLPPVVIPIVPDTEQQIDKQGHFDRTPNPSAITWTVDINQAMKDQTNPTVTETWPTGNTFKSVKVYELVMNLDGTIKEVGRELSPDEYTVDKNGNVTIKGDTNKAYRLEYQTTIDEAVIPDGGGDVPFKNHATLTSDNNPNGLDAEATVTATYGKMLDKRNIDYDEANQEFTWEINYNYGEQTIPKDQAVITDTMGDNLTFEPDSLHLYSVTFDDKGNEVVGAELVEGKDYKVVINGDGSFAIDFLHDVTGAVKIDYKTKVDGIVEGDVAVNNRVDVGTGQHSEDDGTASQQNIIKNTGAVDYQNSTIGWTLAVNQNNYLMENAVITDTYEPVPGLTMVPNSLVVKDTTTGAQLTLGKDFMVEITRNADGETGFKVSFIGAYAKTSDAFHITYTTFFDVTELDANNPALDHYRNTAAIDW

SEQ ID NO: 461 - DNA, 6168 bp; double-stranded, linear; identical to SEQ ID NO: 457

SEQ ID NO: 462 - protein, 2032 aa; identical to SEQ ID NO: 458

SEQ ID NO: 463 - DNA, 1825 bp; double-stranded, linear
tgccttccacataacttatactacctttttgacggatccaattttaaccaatcaaacctatttggctgggagcttgaaagtctatgaaggcaatacaaagccagatggttcggttgaaaaagtgaaaccaacgcaaccgttgacggatatcacaatggaagaaccaagcgagaaaaaccaaaatacttggcgtgttgattttcctaatgatagtcgtacgtatgtgattgaatttaagacgtctgttgatgaaaaagttatcgaaggttcggctagttatgacaataccgcatcttatacaaaccaaggttcttcacgtgatgtgacaggaaaagtttctattcaacatggtggcgaatcagtgaaaaaaggtggcgaataccacaaagatgatccagatcatgtgtactggcatgtaatgatcaatggcgcccaatcggttttagacgatgtggttattactgatacaccctcaccaaaccaagtgctagatcccgagtcattggtgatttacggtaccaacgtaacagaagacggaactattacgccagataaatctgttattttagaagaaggaaaagattacacactggaagttaccaccgataatgaaacaggacaacaaaaaattgtcgttaaaatggcccatattgaagcaccttattatatggaatatcgtagtttagtgacttcttcagcggcggggagtacagacacggtatccaaccaagtgtcaattactggaaatggttcagaagtcgttcatggggatgacaatggcgatgtggtcgttgacattgatcacagtggcgggcatgccacagggactaaaggcaaaattcagctgaagaaaacagccatggatgagacgactattttagcaggcgcccatttccaaatttgggaccaagctaaaacacaagtcctacgtgaaggtacagtagatgccaccggggttatcacatttggtgggttgccacaagggcaatacattttggtggagacaaaagcaccagaaggctatacagtttcggacgaattagctaaaggccgagtcattactattgatgaagaaacttcagccgaaggagcacaaccaaccattattaaaaacgatgtcaataaagtatttttagaaaaaatggatgagaagggtaaaaagttagtcaatgctcgctttaaattagagcatgccgtaaccacgccgtttactcattgggaagaagttccccttgcgccggatcgaaccaacgcgaatggccagttagaggtggatagtttaaaaccagggctttatcagttcacagaaatcgaagcaccgacaggctatcttttagacacgacccccaaacgattcatcgtgacacaaaatacgagcggacaaattcgtgatgttcatgtcaaaatgcttaattaccaaggttctgctgaactaattaaaaaagaccaagcaggcaatccattagcaggtgctgaattttcagtccttgacaccacaggacaagcagttcgagaacacttagtttcggatgcaaacggaaaagtcacagtgacggatttagccccaggaaaatatcaatttgtggaaaccaaagcgccagcagggtaccttttaaacactgaaccaagtgctttcacgattgcagcaagcgatcggggcaaaccagcaacagttatagcaacggctaactttgttaactatcaaggcacggctaaattaatcaaaaaagatgtgaatggacacttattaagtggtgcgacatttaaagtgcttgatgcgaagggagaaacgattcaaacaggcttgacgacaaataatcaaggg

SEQ ID NO: 464 - protein, 688 aa
AFHITYTTFFDVTELDANNPALDHYRNTAAIDWTDEAGNNHHSEDSKPFKPLPAFDLNAQKSGVYNAVTKEITWTIAVNLSNNRLVDAFLTDPILTNQTYLAGSLKVYEGNTKPDGSVEKVKPTQPLTDITMEEPSEKNQNTWRVDFPNDSRTYVIEFKTSVDEKVIEGSASYDNTASYTNQGSSRDVTGKVSIQHGGESVKKGGEYHKDDPDHVYWHVMINGAQSVLDDVVITDTPSPNQVLDPESLVIYGTNVTEDGTITPDKSVILEEGKDYTLEVTTDNETGQQKIVVKMAHIEAPYYMEYRSLVTSSAAGSTDTVSNQVSITGNGSEVVHGDDNGDVVVDIDHSGGHATGTKGKIQLKKTAMDETTILAGAHFQIWDQAKTQVLREGTVDATGVITFGGLPQGQYILVETKAPEGYTVSDELAKGRVITIDEETSAEGAQPTIIKNDVNKVFLEKMDEKGKKLVNARFKLEHAVTTPFTHWEEVPLAPDRTNANGQLEVDSLKPGLYQFTEIEAPTGYLLDTTPKRFIVTQNTSGQIRDVHVKMLNYQGSAELIKKDQAGNPLAGAEFSVLDTTGQAVREHLVSDANGKVTVTDLAPGKYQFVETKAPAGYLLNTEPSAFTIAASDRGKPATVIATANFVNYQGTAKLIKKDVNGHLLSGATFKVLDAKGETIQTGLTTNNQG

SEQ ID NO: 465 - DNA, 6168 bp; double-stranded, linear; identical to SEQ ID NO: 457

SEQ ID NO: 466 - protein, 2032 aa; identical to SEQ ID NO: 458

SEQ ID NO: 467 - DNA, 1864 bp; double-stranded, linear
taactttgttaactatcaaggcacggctaaattaatcaaaaaagatgtgaatggacacttattaagtggtgcgacatttaaagtgcttgatgcgaagggagaaacgattcaaacaggcttgacgacaaataatcaaggggaaattgttgcagagcacttagccccaggaaaatatcgctttgtagaaaccaaagcgccaacaggctatttattaaataccacgccagtcccatttgaaattgctgagaaaaatgctggtaaaccagcggtcgtggttgctagtgacaactttgtgagttacaaaggggctttccaaatcgtgaaaacgaatagcgcagaccaaccattagcaggtgctgtttttgaattatatgatcacaataaacaatcattagggattacagcaacgagtggcaaagatggcaaaattatctttagagacttggcgccaggtacctattattacaaagaaatcaaagcaccaaaattaccagatggcgcagattatattatttatcctgaattagtaaaagtagaaattcgtggtgatttcaaaggtgatccggagattttccaattaggggccttcgccaatttcaaaggacgcgccgtctttaagaaaattgatgccaatgcgaacccacttccaggaacgatttttaaattgtatcgaatcgaaaacggggaaaaaatctttgaaagagaagtaactgctgaaaaagatggttcattggctatggaggatttaggtgctggtagctatgaattagatgaactggatgcaacggatggctatatcgtcaataaacaacccatttattttgtagtgaagaagaattcaaatgataaacaaccactagatgagttagagtttgtaaattatcaagcagaagtaatgggacgtaaagtcaacgagcaaggtcaaaccttagcgggtgcagtttttgcaatttacaatgccgatgagcagaatcagccccaaggttcaccgataacattcttgaatcgtgcaggagaaaaagtttctgaaataacaacggataagactggcgaaatttacgctaaagggctaaatgaagggcattacgttttagtggaaacgaaagcaccaacaggctatctgttagacacaacgctacatccatttgatgtaaccgcccaattaggaaaagagcagccaattgctttaggcgatcttatcaattatcaaggaactgctcaattaaccaaagaaaacgaaacaggtgaagcattggcaggtgcggtgtttaaggtcattgatgaaacagggcaaaccgtagatggacaaaccaatctgatgtctgacaagcaaggcaaagtcattgcgaaaaacttagcaccgggaacgtatcgttttgtggagacacaagcgccaactagctatcttcttaatgaaacgccaagcgcaagctttacgattgccaaagacaaccaaggcaaaccagccactgtggtacttaaagcaccttttattaattaccaaggtgctgccaagctggtgaaaattgatcagcaaaagaatgccttagcaggtgctgaatttaaagtgacagatgcagagacagggcaaactgtcgctcgttcattacgttctgacaaccaagggttagttcaagtgaaccacttacaaccaggaaaatatacctttgtggaaacaaaagcaccggatggttaccaactgtctaagcaagctgtcgcattcactattgcggcaacagcgaaagacaaacctgaactcgtgaatgcgggcacgtttgttaacgagaaacaacctgtatccaaaaaaacaaaaccaaatcagccaacaacgaaacaagcagctagagagacaggttggcttggt

SEQ ID NO: 468 - protein, 621 aa
NFVNYQGTAKLIKKDVNGHLLSGATFKVLDAKGETIQTGLTTNNQGEIVAEHLAPGKYRFVETKAPTGYLLNTTPVPFEIAEKNAGKPAVVVASDNFVSYKGAFQIVKTNSADQPLAGAVFELYDHNKQSLGITATSGKDGKIIFRDLAPGTYYYKEIKAPKLPDGADYIIYPELVKVEIRGDFKGDPEIFQLGAFANFKGRAVFKKIDANANPLPGTIFKLYRIENGEKIFEREVTAEKDGSLAMEDLGAGSYELDELDATDGYIVNKQPIYFVVKKNSNDKQPLDELEFVNYQAEVMGRKVNEQGQTLAGAVFAIYNADEQNQPQGSPITFLNRAGEKVSEITTDKTGEIYAKGLNEGHYVLVETKAPTGYLLDTTLHPFDVTAQLGKEQPIALGDLINYQGTAQLTKENETGEALAGAVFKVIDETGQTVDGQTNLMSDKQGKVIAKNLAPGTYRFVETQAPTSYLLNETPSASFTIAKDNQGKPATVVLKAPFINYQGAAKLVKIDQQKNALAGAEFKVTDAETGQTVARSLRSDNQGLVQVNHLQPGKYTFVETKAPDGYQLSKQAVAFTIAATAKDKPELVNAGTFVNEKQPVSKKTKPNQPTTKQAARETGWLG

SEQ ID NO: 469 - DNA, 2916 bp; double-stranded, linear; identical to SEQ ID NO: 245

SEQ ID NO: 470 - protein, 962 aa; identical to SEQ ID NO: 246

SEQ ID NO: 471 - DNA, 1078 bp; double-stranded, linear
tgaagaagcggttaaagcaggagatacagaaggaatgaccaatacggtgaaagtgaaagacgacagtctggctgattgtaaacggatattggaaggacaagctactttcccagttcaagcgggtgaaacggaaccagtcgatttagtagttgttgaagatgctagtggtagtttttcagataattttccacatgtaagacaagcgattgatgaagtggttcaaggcttatctgatcaagaccgcgtgatgctggcttcatatcgcggcggaaaacaatttatgtttcctgatggaaagacaaaaattaattcagctgattatgatatgaatgtgcgcgtcaatacgcaattgacttatgataaaagccaatttgtctctggttttggagacgttcggacgtatggtggtacgccaaccgccccaggattgaaactcgctttagatacgtacaatcaaacacacggagatttaacgaatcgaaaaacgtatttcctattagtgacagatggggtcgctaatacacgtttagatggttacttgcataagaccaataccaatgattcaatcaatgaatatccagatccaagacatcctcttcaagtctcagtggaatatagtaatgactaccaaggtgcagcagcagaagttttagcgttaaaccaagaaattactaaccaaggctatgaaatgattaatgcgtattgggaaagtgttgaatctttaagttcagtgaattcatactttgataaatataaaacagaagtgggtccttttgtaaaacaagagttgcaacaagggtctagcacaccagaagattttattacaagccaatctattgatgattttacaacccaattaaaacaaattgtcaaagatcgtctggcgcaatcgacaccagcaacagcttcattaacgattgccaatcaatttgatattcaatctgcgaccgctacggacgatgctggaaatgatgtgcctgttcaaattaacggacaaaccatttcagcaactagtacagaaggttacgtaggaaacatcacgattcactacgaagtcaaagaaaatacagcgattgat

SEQ ID NO: 472 - protein, 359 aa
EEAVKAGDTEGMTNTVKVKDDSLADCKRILEGQATFPVQAGETEPVDLVVVEDASGSFSDNFPHVRQAIDEVVQGLSDQDRVMLASYRGGKQFMFPDGKTKINSADYDMNVRVNTQLTYDKSQFVSGFGDVRTYGGTPTAPGLKLALDTYNQTHGDLTNRKTYFLLVTDGVANTRLDGYLHKTNTNDSINEYPDPRHPLQVSVEYSNDYQGAAAEVLALNQEITNQGYEMINAYWESVESLSSVNSYFDKYKTEVGPFVKQELQQGSSTPEDFITSQSIDDFTTQLKQIVKDRLAQSTPATASLTIANQFDIQSATATDDAGNDVPVQINGQTISATSTEGYVGNITIHYEVKENTAID

SEQ ID NO: 473 - DNA, 2916 bp; double-stranded, linear; identical to SEQ ID NO: 245

SEQ ID NO: 474 - protein, 962 aa; identical to SEQ ID NO: 246

SEQ ID NO: 475 - DNA, 682 bp; double-stranded, linear
gaatcaaggaacaattgctaaggaatttccagaagcgacgattcctaaaaatgacaatgcgcatgcgtgtgacgtgacgccagaagatccaacgattacaaaagatatcgaaaatcaagaacacttagatttaaccaatcgtgaagatagtttcgattggcatgtcaaaacagcctttggcaacgaaaccagtacttggacccaagccagcatggtggatgacattaataaagtgctagatatcattgatgtgaaagtcaccgacgaaaatggtaaagatgttacagctaacggcacagtaacacaagaaaataacaaagtaacttttgaaatgaacaaacaagcagacagctatgactatttaagtggtcatacgtatacaatgactatcaccactaaaattaaaactgacgcaacggacgaagaattagcgccttacattgaacaaggcgggattcccaaccaagccgacttaaactttggcaatgaaggtgacgtgttacattccaacaaaccaaccgtaacaccaccgccagttgatccaaatattgctaaagacgtagaaggacaagaacatttagatttaaccaaccgcgatcaagaatttaaatggaacgtcaaaacagctttcggtaacgaaacaagcacttggacccaagccagcatggtagatgacattaat

SEQ ID NO: 476 - protein, 227 aa
NQGTIAKEFPEATIPKNDNAHACDVTPEDPTITKDIENQEHLDLTNREDSFDWHVKTAFGNETSTWTQASMVDDINKVLDIIDVKVTDENGKDVTANGTVTQENNKVTFEMNKQADSYDYLSGHTYTMTITTKIKTDATDEELAPYIEQGGIPNQADLNFGNEGDVLHSNKPTVTPPPVDPNIAKDVEGQEHLDLTNRDQEFKWNVKTAFGNETSTWTQASMVDDIN

SEQ ID NO: 477 - DNA, 2916 bp; double-stranded, linear; identical to SEQ ID NO: 245

SEQ ID NO: 478 - protein, 962 aa; identical to SEQ ID NO: 246

SEQ ID NO: 479 - DNA, 868 bp; double-stranded, linear
agatgaaaatggtaaagatgttacagctaacggcaaagtaacacaagaaaataacaaagtaacttttgaaatgaacaancaagcngacagctatgactatttaagtggtcatacgtacacaatgaccattactactaaaatcaaagctagcgcaacggacgaagaattagcaccttatattgaacaaggtggcattcccaaccaagccgacttgaactttggcaacgaaggtgacgtgttgcattccaacaaaccaaccgtaacaccacctgcaccaacgccagaagatccaacgattacaaaagatatcgaaggccaagaacatttagatttaaccaaccgtgaccaagaatttaaatggaacgtcaaaacagctttcggtaacgaaacaagcacatggacccaagccagcatggtggatgacattaataaagtgttagacatcacagacgtgaaagttnctgangaaaatggcaaagatgttacagataatggcatagtaacacaagaaaataacaaagtaacttttactatgaacaaaaaagatgacagctactcttacttagctggtcatacatacacaatgactattaccactaaaattaaaactgacgcaacggatgaagaattagcgccttatattgaacaaggcgggattcccaaccaagccgacttaaactttggcaacgaaggtgacgtgttgcattccaacaagccaaccgtaacaccgcctgcaccaacgccagaagacccaaaaaaacctgaacctaaacaaccgctaaaaccgaaaaaaccgttgacgcctacaaatcatcaagcaccaacgaacccagtcaattttggaaaatcagcaagtaaaggaattcat

SEQ ID NO: 480 - protein, 289 aa
DENGKDVTANGKVTQENNKVTFEMNXQADSYDYLSGHTYTMTITTKIKASATDEELAPYIEQGGIPNQADLNFGNEGDVLHSNKPTVTPPAPTPEDPTITKDIEGQEHLDLTNRDQEFKWNVKTAFGNETSTWTQASMVDDINKVLDITDVKVXXENGKDVTDNGIVTQENNKVTFTMNKKDDSYSYLAGHTYTMTITTKIKTDATDEELAPYIEQGGIPNQADLNFGNEGDVLHSNKPTVTPPAPTPEDPKKPEPKQPLKPKKPLTPTNHQAPTNPVNFGKSASKGIH

SEQ ID NO: 481 - DNA, 1356 bp; double-stranded, linear
tgacaagtgaagaaacgtctatttgcatcagtattactatgttcattaacgctatcagcaattgctaccccaagcatcgctttggcggacaatgttgataaaaaaattgaagaaaaaaatcaagaaatttcatcattaaaagcaaaacaaggggatttagcttcacaagtatcttctttagaagcagaagtatcttcagtatttgatgaaagcatggctttacgtgaacaaaagcaaacactaaaagcaaaatcagaacaattacaacaagaaattacaaacttgaatcaacgtattgaaaaacgtaacgaagcaatcaaaaatcaagcacgtgatgttcaagttaatggacaaagcacaacaatgctagatgcagttttagatgcggactcagttgcagatgcaatcagccgtgttcaagctgtttcaacaatcgtaagtgccaacaacgacttaatgcaacaacaaaaagaagacaaacaagccgttgttgataaaaaagctgaaaacgagaaaaaagtgaaacaacttgaagcaacagaagctgaattagaaacaaaacgtcaagatttactttctaaacaatctgaattaaacgtaatgaaagcttcattagcattagaacaatcatcagctgaaagttctaaagctggcttagaaaaacaaaaagcagctgctgaagcagagcaagcacgcttagctgctgaacaaaaagctgcagctgaaaaagccaaacaagctgctgcaaaaccagctaaagctgaagtgaaagcagaagcaccagttgcctcttcatcaacaacagaagcacaagcaccagcaagctcaagctcagcaactgaatcaagcacgcaacaaacaactgaaacaactacaccaagtacagataatagtgcaacagaaaatactggctcttcttcatcagaacaaccagtacaacctacaacaccaagcgataatggaaataatggtggccaaactggtggtggaacagttacaccaacaccagaaccaacaccagcgccttctgctgatccaacaatcaatgcattgaacgttctacgtcaatcattaggtttacgtccagtagtatgggatgcaggtttggcagcttctgcaactgctcgtgcagcacaagttgaagcaggtggcattccaaatgatcactggtctcgtggagatgaagttatcgcaattatgtgggcgccaggtaactcagtaatcatggcgtggtacaatgaaacaaacatggtaacagcttcaggaagcggtcaccgtgattgggaaattaacccaggtattacgcgtgtcggttttggttactcaggtagcacaatcgtaggacactcagcctaa

SEQ ID NO: 482 - protein, 449 aa
VKKRLFASVLLCSLTLSAIATPSIALADNVDKKIEEKNQEISSLKAKQGDLASQVSSLEAEVSSVFDESMALREQKQTLKAKSEQLQQEITNLNQRIEKRNEAIKNQARDVQVNGQSTTMLDAVLDADSVADAISRVQAVSTIVSANNDLMQQQKEDKQAVVDKKAENEKKVKQLEATEAELETKRQDLLSKQSELNVMKASLALEQSSAESSKAGLEKQKAAAEAEQARLAAEQKAAAEKAKQAAAKPAKAEVKAEAPVASSSTTEAQAPASSSSATESSTQQTTETTTPSTDNSATENTGSSSSEQPVQPTTPSDNGNNGGQTGGGTVTPTPEPTPAPSADPTINALNVLRQSLGLRPVVWDAGLAASATARAAQVEAGGIPNDHWSRGDEVIAIMWAPGNSVIMAWYNETNMVTASGSGHRDWEINPGITRVGFGYSGSTIVGHSA

SEQ ID NO: 483 - DNA, 1267 bp; double-stranded, linear
ggacaatgttgataaaaaaattgaagaaaaaaatcaagaaatttcatcattaaaagcaaaacaaggggatttagcttcacaagtatcttctttagaagcagaagtatcttcagtatttgatgaaagcatggctttacgtgaacaaaagcaaacactaaaagcaaaatcagaacaattacaacaagaaattacaaacttgaatcaacgtattgaaaaacgtaacgaagcaatcaaaaatcaagcacgtgatgttcaagttaatggacaaagcacaacaatgctagatgcagttttagatgcggactcagttgcagatgcaatcagccgtgttcaagctgtttcaacaatcgtaagtgccaacaacgacttaatgcaacaacaaaaagaagacaaacaagccgttgttgataaaaaagctgaaaacgagaaaaaagtgaaacaacttgaagcaacagaagctgaattagaaacaaaacgtcaagatttactttctaaacaatctgaattaaacgtaatgaaagcttcattagcattagaacaatcatcagctgaaagttctaaagctggcttagaaaaacaaaaagcagctgctgaagcagagcaagcacgcttagctgctgaacaaaaagctgcagctgaaaaagccaaacaagctgctgcaaaaccagctaaagctgaagtgaaagcagaagcaccagttgcctcttcatcaacaacagaagcacaagcaccagcaagctcaagctcagcaactgaatcaagcacgcaacaaacaactgaaacaactacaccaagtacagataatagtgcaacagaaaatactggctcttcttcatcagaacaaccagtacaacctacaacaccaagcgataatggaaataatggtggccaaactggtggtggaacagttacaccaacaccagaaccaacaccagcgccttctgctgatccaacaatcaatgcattgaacgttctacgtcaatcattaggtttacgtccagtagtatgggatgcaggtttggcagcttctgcaactgctcgtgcagcacaagttgaagcaggtggcattccaaatgatcactggtctcgtggagatgaagttatcgcaattatgtgggcgccaggtaactcagtaatcatggcgtggtacaatgaaacaaacatggtaacagcttcaggaagcggtcaccgtgattgggaaattaacccaggtattacgcgtgtcggttttggttactcaggtagcacaatcgtaggacactcagcc

SEQ ID NO: 484 - protein, 422 aa
DNVDKKIEEKNQEISSLKAKQGDLASQVSSLEAEVSSVFDESMALREQKQTLKAKSEQLQQEITNLNQRIEKRNEAIKNQARDVQVNGQSTTMLDAVLDADSVADAISRVQAVSTIVSANNDLMQQQKEDKQAVVDKKAENEKKVKQLEATEAELETKRQDLLSKQSELNVMKASLALEQSSAESSKAGLEKQKAAAEAEQARLAAEQKAAAEKAKQAAAKPAKAEVKAEAPVASSSTTEAQAPASSSSATESSTQQTTETTTPSTDNSATENTGSSSSEQPVQPTTPSDNGNNGGQTGGGTVTPTPEPTPAPSADPTINALNVLRQSLGLRPVVWDAGLAASATARAAQVEAGGIPNDHWSRGDEVIAIMWAPGNSVIMAWYNETNMVTASGSGHRDWEINPGITRVGFGYSGSTIVGHSA

SEQ ID NO: 485 - DNA, 759 bp; double-stranded, linear
tgatacattaaaaggagggaaaatatgcgcccaaaagagaaaaaaagaggaaaaaattggttaatcaacagtttattagttttactatttatcattggcttagccttaatttttaacaatcagatacgtagttgggtggttcaacaaaatagccgctcgtacgccgttagcaagttgaaaccagctgatgtgaagaaaaatatggctcgtgaaacaacgtttgactttgattcagttgagtccttgagcacagaagcggtgatgaaagcccaatttgaaaacaaaaacttacctgtgattggtgccattgcgataccaagtgtcgaaattaatttgcccatttttaaaggattgtccaatgtcgctttattaactggtgccgggaccatgaaagaagatcaagtcatggggaaaaacaattatgccttggctagtcatcgaacggaagatggcgtttccttattttcacctttagaaagaaccaaaaaagacgaactcatttatatcactgatttatctactgtttatacatacaaaataacttctgtagaaaaaatcgaaccaacccgtgttgagttaattgatgacgttcctggtcaaaatatgattaccttaattacctgtggcgatttacaagcaacgacgcgaattgctgttcaaggaacattagcagcaacgacgcctattaaagacgccaacgacgatatgttgaaggctttccaattggagcaaaaaactttagccgattgggtggcttaa

SEQ ID NO: 486 - protein, 251 aa
YIKRRENMRPKEKKRGKNWLINSLLVLLFIIGLALIFNNQIRSWVVQQNSRSYAVSKLKPADVKKNMARETTFDFDSVESLSTEAVMKAQFENKNLPVIGAIAIPSVEINLPIFKGLSNVALLTGAGTMKEDQVMGKNNYALASHRTEDGVSLFSPLERTKKDELIYITDLSTVYTYKITSVEKIEPTRVELIDDVPGQNMITLITCGDLQATTRIAVQGTLAATTPIKDANDDMLKAFQLEQKTLADWVA

SEQ ID NO: 487 - DNA, 592 bp; double-stranded, linear
cgttagcaagttgaaaccagctgatgtgaagaaaaatatggctcgtgaaacaacgtttgactttgattcagttgagtccttgagcacagaagcggtgatgaaagcccaatttgaaaacaaaaacttacctgtgattggtgccattgcgataccaagtgtcgaaattaatttgcccatttttaaaggattgtccaatgtcgctttattaactggtgccgggaccatgaaagaagatcaagtcatggggaaaaacaattatgccttggctagtcatcgaacggaagatggcgtttccttattttcacctttagaaagaaccaaaaaagacgaactcatttatatcactgatttatctactgtttatacatacaaaataacttctgtagaaaaaatcgaaccaacccgtgttgagttaattgatgacgttcctggtcaaaatatgattaccttaattacctgtggcgatttacaagcaacgacgcgaattgctgttcaaggaacattagcagcaacgacgcctattaaagacgccaacgacgatatgttgaaggctttccaattggagcaaaaaactttagccgattgggtggct

SEQ ID NO: 488 - protein, 197 aa
VSKLKPADVKKNMARETTFDFDSVESLSTEAVMKAQFENKNLPVIGAIAIPSVEINLPIFKGLSNVALLTGAGTMKEDQVMGKNNYALASHRTEDGVSLFSPLERTKKDELIYITDLSTVYTYKITSVEKIEPTRVELIDDVPGQNMITLITCGDLQATTRIAVQGTLAATTPIKDANDDMLKAFQLEQKTLADWVA

SEQ ID NO: 489 - DNA, 1185 bp; double-stranded, linear
taggcggaggtaagcggtatgcgtaaacgacatgcaaagaaaagacatggaggagtgaattggctttttatagtatgtttgttggtggtgattggtggtagtggttatttaataaaaacgttctttttcactagagattcacaagttagtcaagaatcgaaagtggtcttggaagaagatcgccgaagtgataattatgcgaatttaacgaaagaaatagttgcaccagatagtggcgaacttgatcaaaaaattcaagaaacaaattatattggttcggctttgatcattaaagatgatcaggttttagtaaataaaggatatggctttgccaattttgaaaagcaacaagccaacacgccaaacacaaggtttcagattggctcaattcaaaaatcttttaccacaaccttgatcttaaaagcaattgaagaaggtaaacttacattagatacaaaactcgctacgttttatccgcaaattcaaggtgctgaggatattacgattagcgatatgttgaatatgacaagtggtttaaagttatcagcaatgcctaataatatcgttaccgatgaagaaattattcaatttgttaaacaaaataccattcaagtcaataaaggaaaatacaattattccccagtaaattttgtccttttagcaggaatgttagagaaaatgtatcaacgtacctatcaagaattatttaataatctttatcacaaaacggctggtttaaagaattttggcttctatgaaaccttattggaacagcccaataattcaacaagttataaatggacagaagataattcatataaccaagtgctctcaattcctgcagctagttttgcccatgaatttgggactggtaatgtggatatgacgacaggtgatttgtattggtacttacatcaattaacgagtggacatttagtttccaccgcacttttgcaaaaattatggacgtcttctcagcaaagctcttatcatggcggcatctatgttcatgataattatttacgtttacacggcgttgaagcgggtcaacaagccctggttttattttcaaaagatatgaagacaggggtcatattgctaactaactgtgtgaatccagcgaaatacaaagaattaattggttcgttgttccatgatgtaaccaatttaactgttaaattttaa

SEQ ID NO: 490 - protein, 388 aa
MRKRHAKKRHGGVNWLFIVCLLVVIGGSGYLIKTFFFTRDSQVSQESKVVLEEDRRSDNYANLTKEIVAPDSGELDQKIQETNYIGSALIIKDDQVLVNKGYGFANFEKQQANTPNTRFQIGSIQKSFTTTLILKAIEEGKLTLDTKLATFYPQIQGAEDITISDMLNMTSGLKLSAMPNNIVTDEEIIQFVKQNTIQVNKGKYNYSPVNFVLLAGMLEKMYQRTYQELFNNLYHKTAGLKNFGFYETLLEQPNNSTSYKWTEDNSYNQVLSIPAASFAHEFGTGNVDMTTGDLYWYLHQLTSGHLVSTALLQKLWTSSQQSSYHGGIYVHDNYLRLHGVEAGQQALVLFSKDMKTGVILLTNCVNPAKYKELIGSLFHDVTNLTVKF

SEQ ID NO: 491 - DNA, 1075 bp; double-stranded, linear
tttaataaaaacgttctttttcactagagattcacaagttagtcaagaatcgaaagtggtcttggaagaagatcgccgaagtgataattatgcgaatttaacgaaagaaatagttgcaccagatagtggcgaacttgatcaaaaaattcaagaaacaaattatattggttcggctttgatcattaaagatgatcaggttttagtaaataaaggatatggctttgccaattttgaaaagcaacaagccaacacgccaaacacaaggtttcagattggctcaattcaaaaatcttttaccacaaccttgatcttaaaagcaattgaagaaggtaaacttacattagatacaaaactcgctacgttttatccgcaaattcaaggtgctgaggatattacgattagcgatatgttgaatatgacaagtggtttaaagttatcagcaatgcctaataatatcgttaccgatgaagaaattattcaatttgttaaacaaaataccattcaagtcaataaaggaaaatacaattattccccagtaaattttgtccttttagcaggaatgttagagaaaatgtatcaacgtacctatcaagaattatttaataatctttatcacaaaacggctggtttaaagaattttggcttctatgaaaccttattggaacagcccaataattcaacaagttataaatggacagaagataattcatataaccaagtgctctcaattcctgcagctagttttgcccatgaatttgggactggtaatgtggatatgacgacaggtgatttgtattggtacttacatcaattaacgagtggacatttagtttccaccgcacttttgcaaaaattatggacgtcttctcagcaaagctcttatcatggcggcatctatgttcatgataattatttacgtttacacggcgttgaagcgggtcaacaagccctggttttattttcaaaagatatgaagacaggggtcatattgctaactaactgtgtgaatccagcgaaatacaaagaattaattggttcgttgttccatgatgtaaccaatttaactgttaaattt

SEQ ID NO: 492 - protein, 358 aa
LIKTFFFTRDSQVSQESKVVLEEDRRSDNYANLTKEIVAPDSGELDQKIQETNYIGSALIIKDDQVLVNKGYGFANFEKQQANTPNTRFQIGSIQKSFTTTLILKAIEEGKLTLDTKLATFYPQIQGAEDITISDMLNMTSGLKLSAMPNNIVTDEEIIQFVKQNTIQVNKGKYNYSPVNFVLLAGMLEKMYQRTYQELFNNLYHKTAGLKNFGFYETLLEQPNNSTSYKWTEDNSYNQVLSIPAASFAHEFGTGNVDMTTGDLYWYLHQLTSGHLVSTALLQKLWTSSQQSSYHGGIYVHDNYLRLHGVEAGQQALVLFSKDMKTGVILLTNCVNPAKYKELIGSLFHDVTNLTVKF

SEQ ID NO: 493 - DNA, 1005 bp; double-stranded, linear
tagttttctaatctcaccaaaacaaaaatttttaagaaagaaggagagatcgttatgatgagaaaatggaaagtagtagtgggaagtctgggaatgttgattgctctttttatattcggggcatgttcaacaaatagtaaagacaaagatacagtggcttcgaacgaaaaattaaaggtagtagttactaattcgattttagcagatattactgaaaatatagcaaaagataaaattgatttacacagtatcgtacctattgggaaagatccccacgaatatgaacctttgcctgaagatgttcaaaaaacttcaaaagcagatttgattttttataacggtgttaacttggamactggaggaaatgcttggtttacaaaattagtaaaamatgcgaacaaagaggaaaacaaagactattttgcagcaagtgatggcatagatgttatttacttagagggtcagagtgagaaagggaaggaagatccccatgcttggttaaatttagaaaacggtattatttacgctaaaaatattgaaaaatggttagcggaaaaagatcctgataataaaaaattctataaagaaaatctagataagtatattgaaaagttggattctctagacaaagaagctaaatctaaatttgcttcaattccgaatgataaaaaaatgattgttacaagtgaaggatgctttaaatatttctcgaaagcgtataatgtgccttctgcttacatttgggaaatcaacactgaagaagaaggaacaccagatcaaataaaacacttagttgaaaaattacgcacaacaaaagttccctccttattcgtagaaagtagtgtggacgatagaccgatgaaaacagtatcaaaagataccaatattcctatctattcaacgatttttactgattcaattgcagaaaaaggacaagatggtgatagttactatgcgatgatgaaatggaacctggataaaattgctgaaggcctttcgaaataa

SEQ ID NO: 494 - protein, 316 aa
MMRKWKVVVGSLGMLIALFIFGACSTNSKDKDTVASNEKLKVVVTNSILADITENIAKDKIDLHSIVPIGKDPHEYEPLPEDVQKTSKADLIFYNGVNLXTGGNAWFTKLVKXANKEENKDYFAASDGIDVIYLEGQSEKGKEDPHAWLNLENGIIYAKNIEKWLAEKDPDNKKFYKENLDKYIEKLDSLDKEAKSKFASIPNDKKMIVTSEGCFKYFSKAYNVPSAYIWEINTEEEGTPDQIKHLVEKLRTTKVPSLFVESSVDDRPMKTVSKDTNIPIYSTIFTDSIAEKGQDGDSYYAMMKWNLDKIAEGLSK

SEQ ID NO: 495 - DNA, 880 bp; double-stranded, linear
atgttcaacaaatagtaaagacaaagatacagtggcttcgaacgaaaaattaaaggtagtagttactaattcgattttagcagatattactgaaaatatagcaaaagataaaattgatttacacagtatcgtacctattgggaaagatccccacgaatatgaacctttgcctgaagatgttcaaaaaacttcaaaagcagatttgattttttataacggtgttaacttggamactggaggaaatgcttggtttacaaaattagtaaaamatgcgaacaaagaggaaaacaaagactattttgcagcaagtgatggcatagatgttatttacttagagggtcagagtgagaaagggaaggaagatccccatgcttggttaaatttagaaaacggtattatttacgctaaaaatattgaaaaatggttagcggaaaaagatcctgataataaaaaattctataaagaaaatctagataagtatattgaaaagttggattctctagacaaagaagctaaatctaaatttgcttcaattccgaatgataaaaaaatgattgttacaagtgaaggatgctttaaatatttctcgaaagcgtataatgtgccttctgcttacatttgggaaatcaacactgaagaagaaggaacaccagatcaaataaaacacttagttgaaaaattacgcacaacaaaagttccctccttattcgtagaaagtagtgtggacgatagaccgatgaaaacagtatcaaaagataccaatattcctatctattcaacgatttttactgattcaattgcagaaaaaggacaagatggtgatagttactatgcgatgatgaaatggaacctggataaaattgctgaaggcctttcgaaa

SEQ ID NO: 496 - protein, 293 aa
CSTNSKDKDTVASNEKLKVVVTNSILADITENIAKDKIDLHSIVPIGKDPHEYEPLPEDVQKTSKADLIFYNGVNLXTGGNAWFTKLVKXANKEENKDYFAASDGIDVIYLEGQSEKGKEDPHAWLNLENGIIYAKNIEKWLAEKDPDNKKFYKENLDKYIEKLDSLDKEAKSKFASIPNDKKMIVTSEGCFKYFSKAYNVPSAYIWEINTEEEGTPDQIKHLVEKLRTTKVPSLFVESSVDDRPMKTVSKDTNIPIYSTIFTDSIAEKGQDGDSYYAMMKWNLDKIAEGLSK

What is claimed is:

1. An isolated polynucleotide fragment comprising a nucleic acid sequence encoding the full length amino acid sequence in SEQ ID NO: 154.

2. The isolated polynucleotide fragment of claim 1, wherein said polynucleotide fragment further comprises a heterologous polynucleotide sequence.

3. The isolated polynucleotide fragment of claim 2, wherein said heterologous polynucleotide sequence encodes a heterologous polypeptide.

4. A method for making a recombinant vector comprising inserting the isolated polynucleotide fragment of claim 1 into a vector.

5. A nucleic acid sequence complementary to the polynucleotide fragment of claim 1.

6. A recombinant vector comprising the isolated polynucleotide fragment of claim 1.

7. The recombinant vector of claim 6, wherein said isolated polynucleotide fragment is operably associated with a heterologous regulatory sequence that controls gene expression.

8. An isolated heterologous host cell comprising the isolated polynucleotide fragment of claim 2.

9. The isolated host cell of claim 8, wherein said polynucleotide fragment is operably associated with a heterologous regulatory sequence that controls gene expression.

10. A method for producing a polypeptide, comprising culturing an isolated host cell under conditions suitable to produce a heterologous polypeptide encoded by the polynucleotide fragment of claim 2.

11. An isolated polynucleotide fragment comprising a nucleic acid sequence encoding an epitope-bearing portion of the amino acid sequence encoded by SEQ ID NO:153 consisting of:
 (a) amino acid residues from about Lys-167 to about Gly-172 of SEQ ID NO:154; and
 (b) amino acid residues from about Lys-240 to about Asn-242 of SEQ ID NO: 154;
wherein said nucleic acid sequence encodes at least seven contiguous amino acids of SEQ ID NO:154.

12. An isolated polynucleotide fully complementary to the polynucleotide fragment of claim 11.

13. An isolated polynucleotide fragment comprising a nucleic acid sequence encoding at least 15 contiguous amino acid residues of SEQ ID NO:154.

14. An isolated polynucleotide fully complementary to the polynucleotide fragment of claim 13.

15. The isolated polynucleotide fragment of claim 13, wherein said polynucleotide fragment comprises a nucleic acid sequence encoding at least 30 contiguous amino acid residues of SEQ ID NO: 154.

16. An isolated polynucleotide fully complementary to the polynucleotide fragment of claim 15.

17. An isolated polynucleotide fragment comprising at least 50 contiguous nucleotides of SEQ ID NO: 153.

18. An isolated polynucleotide fully complementary to the polynucleotide fragment of claim 17.

19. An isolated polynucleotide fragment comprising at least 100 contiguous nucleotides of SEQ ID NO:153.

20. An isolated polynucleotide fully complementary to the polynucleotide fragment of claim 19.

21. An isolated polynucleotide fragment comprising a nucleic acid sequence encoding the full length amino acid sequence in SEQ ID NO: 156.

22. The isolated polynucleotide fragment of claim 21, wherein said polynucleotide fragment further comprises a heterologous polynucleotide sequence.

23. The isolated polynucleotide fragment of claim 22, wherein said heterologous polynucleotide sequence encodes a heterologous polypeptide.

24. A method for making a recombinant vector comprising inserting the isolated polynucleotide fragment of claim 21 into a vector.

25. A nucleic acid sequence fully complementary to the polynucleotide fragment of claim 21.

26. A recombinant vector comprising the isolated polynucleotide fragment of claim 21.

27. The recombinant vector of claim 26, wherein said polynucleotide fragment is operably associated with a heterologous regulatory sequence that controls gene expression.

28. An isolated heterologous host cell comprising the isolated polynucleotide fragment of claim 21.

29. The isolated host cell of claim 28, wherein said polynucleotide fragment is operably associated with a heterologous regulatory sequence that controls gene expression.

30. A method for producing a polypeptide, comprising culturing an isolated host cell under conditions suitable to produce a heterologous polypeptide encoded by the polynucleotide fragment of claim 21.

31. An isolated polynucleotide fragment comprising at least 100 contiguous nucleotides of SEQ ID NO:155.

32. An isolated polynucleotide fully complementary to the polynucleotide fragment of claim 31.

33. An isolated polynucleotide fragment comprising a nucleic acid sequence encoding at least 15 contiguous amino acid residues of SEQ ID NO:156.

34. An isolated polynucleotide fully complementary to the polynucleotide fragment of claim 33.

35. The isolated polynucleotide fragment of claim 33, wherein said polynucleotide fragment comprises a nucleic acid sequence encoding at least 30 contiguous amino acid residues of SEQ ID NO: 156.

36. An isolated polynucleotide fully complementary to the polynucleotide fragment of claim 35.

37. An isolated polynucleotide fragment comprising at least 50 contiguous nucleotides of SEQ ID NO: 155.

38. An isolated polynucleotide fully complementary to the polynucleotide fragment of claim 37.

* * * * *